United States Patent
Wang et al.

(10) Patent No.: US 8,110,724 B2
(45) Date of Patent: Feb. 7, 2012

(54) NUCLEOTIDE SEQUENCES AND CORRESPONDING POLYPEPTIDES CONFERRING AN ALTERED FLOWERING TIME IN PLANTS

(75) Inventors: Wuyi Wang, Newbury Park, CA (US); Kenneth A. Feldmann, Newbury Park, CA (US)

(73) Assignee: Ceres, INC., Thousand Oaks, CA (US)

( * ) Notice: Subject to any disclaimer, the term of this patent is extended or adjusted under 35 U.S.C. 154(b) by 258 days.

(21) Appl. No.: 12/281,616

(22) PCT Filed: Mar. 14, 2007

(86) PCT No.: PCT/US2007/006651
§ 371 (c)(1),
(2), (4) Date: Dec. 5, 2008

(87) PCT Pub. No.: WO2007/106593
PCT Pub. Date: Sep. 20, 2007

(65) Prior Publication Data
US 2009/0172840 A1    Jul. 2, 2009

Related U.S. Application Data

(60) Provisional application No. 60/782,428, filed on Mar. 14, 2006, provisional application No. 60/821,639, filed on Aug. 7, 2006.

(51) Int. Cl.
*C12N 15/82* (2006.01)
*C12N 5/04* (2006.01)
*A01H 5/00* (2006.01)
*A01H 5/10* (2006.01)

(52) U.S. Cl. ........ 800/278; 800/298; 800/290; 800/287; 426/531; 435/320.1; 435/419

(58) Field of Classification Search .................. None
See application file for complete search history.

(56) References Cited

U.S. PATENT DOCUMENTS
7,635,800 B2 * 12/2009 Ratcliffe et al. .............. 800/290

FOREIGN PATENT DOCUMENTS
WO    WO 2004/031349 A2 *  4/2004

OTHER PUBLICATIONS

Bowie et al, Science 247:1306-1310, 1990.*
McConnell et al, Nature 411 (6838):709-713, 2001.*
Paz-Ares et al (2005, NCBI Accession No. DR750626).*
Eddy, 2004, Nature Biotechnology 22(10):1315-1316.*
Yanagisawa, S., "The Dof family of transcription factors," TRENDS in Plant Science, vol. 7, No. 12, pp. 555-560, 2002.

* cited by examiner

*Primary Examiner* — Stuart F. Baum
(74) *Attorney, Agent, or Firm* — Birch, Stewart, Kolasch and Birch, LLP

(57) ABSTRACT

The present invention relates to isolated nucleic acid molecules and their corresponding encoded polypeptides able to confer the trait of altered flowering time in plants. The present invention further relates to using the nucleic acid molecules and polypeptides to make transgenic plants, plant cells, plant materials or seeds of a plant having flowering times that are altered with respect to wild-type plants grown under similar conditions. Altered flowering time includes both plants having an early flowering time and a late flowering time with respect to wild-type plants grown under similar conditions. Flowering time in plants may be altered either with respect to the normal time at which wild-type plants flower within their normal life cycle or altered temporally such that the entire life cycle of the plant is accelerated or prolonged using the nucleic acid molecules and polypeptides of the present invention.

35 Claims, 32 Drawing Sheets

Figure 1

```
ANNOT-1524415-SEQ-ID-NO-100    MGRGRVELKR ENKI NRQVT FSKRRNGLLK KAYELSVLCD AEVALIIFSS   50
CLONE-241491-SEQ-ID-NO-96      MGRGRVELKR ENKI NRQVT FSKRRNGLLK KAYELSVLCD AEVALIFSG    50
GI-3688591-SEQ-ID-NO-105       MGRGRVELKR ENKI NRQVT FSKRRNGLLK KAYELSVLCD AEVALIFSS    50
GI-44888603-SEQ-ID-NO-106      MGRGKVELKR ENKI NRQVT FSKRRNGLLK KAYELSVLCD AEVALIFSS    50
GI-47681319-SEQ-ID-NO-107      MGRGRVELKR ENKI NRQVT FSKRRNGLLK KAYELSVLCD AEVALIFSS    50
GI-50251892-SEQ-ID-NO-108      MGRGRVELKR ENKI NRQVT FSKRRNGLLK KAYELSVLCD AEVALIIFSS   50

ANNOT-1524415-SEQ-ID-NO-100    RGKLYEFGSA SVTKTLERYQ RCCYTPQE-- NSLERETQSW YLEATKLAK   98
CLONE-241491-SEQ-ID-NO-96      RGKLYEFGSA GVTKTLERYQ HECYNAQDSN NGALSESQSW YQETSKLRAK   100
GI-3688591-SEQ-ID-NO-105       RGKLYEFGSA GITKTLERYQ HCCYNAQDS- NGALSETQSW YQEMSKLKAK   99
GI-44888603-SEQ-ID-NO-106      RGKLYEFGSA GITKTLERYQ HCCYNAQDS- NGALSETQSW YQEMSKLKAK   99
GI-47681319-SEQ-ID-NO-107      RGKLYEFGSA GISKTLERYQ HCCYNAQDS- NNALSETQSW YQEMSKLRAK   98
GI-50251892-SEQ-ID-NO-108      RGKLYEFGSA GITKTLERYQ HCCYNAQDS- NNALSETQSW YFEMSKLKAK   99

ANNOT-1524415-SEQ-ID-NO-100    YESLQRTQRH LGEDLGPLN- VKELQNLEK QLEGALALAR ORKQDVLTEQ   147
CLONE-241491-SEQ-ID-NO-96      FEALQRTQRH LGEDLGPLS- TVKELQQLEK QLECALSQAR ORKTQLMMEQ   150
GI-3688591-SEQ-ID-NO-105       FEALQRTQRH LGEDLGPLS- VKELQQLEK QLECSLSLAR ORKTQLMMEQ   148
GI-44888603-SEQ-ID-NO-106      FEALQRTQRH LGEDLGPLS- VKELQQLEK QLECSLSQAR ORKTQLMMEQ   148
GI-47681319-SEQ-ID-NO-107      FEALQRTQRH LGEDLGPLS- VKELQQLEK QLECALSQAR ORKTQLMMEQ   147
GI-50251892-SEQ-ID-NO-108      RGKLQRTQRH LGEDLGPLS- VKELQQLEK QLECALSQAR ORKTQLMMEQ   148

ANNOT-1524415-SEQ-ID-NO-100    MEDLRKKERH GDLNRHKL- KLEAEGQ--- NLKAIQD-YK NSGAA--DGS   191
CLONE-241491-SEQ-ID-NO-96      VEELRR---- ---------- ---------- ---------- ----------   156
GI-3688591-SEQ-ID-NO-105       VEELRRKERQ GDINRQLKH KLDAEGSNSN NYRAMQQ-SW AAGTVVDEGA   198
GI-44888603-SEQ-ID-NO-106      VEELRKKERQ GDINRQLKH KLDAEGSNSN NYRTMQQ-TW AAGTVVDEGA   198
GI-47681319-SEQ-ID-NO-107      VEELRRKERQ GEINRQLKH KLEAEGSS- NYRAMRASW AFGTVVDEGA   195
GI-50251892-SEQ-ID-NO-108      VEELRRKERQ GEINRQLKH KLEVEGSTS NYRAMQQASW ACGAVVENGA   197

ANNOT-1524415-SEQ-ID-NO-100    SNF------- ---HLERAQSS QMDCDPGPVL QIGY-H--YR PAE--GSSVP   228
CLONE-241491-SEQ-ID-NO-96      ---------- ---------- ---------- ---------- ----------   156
GI-3688591-SEQ-ID-NO-105       AAYHM----Q QQQHPNHSA AMDCE---PTL QIGYPHQ-FA APDQAANNIP   241
GI-44888603-SEQ-ID-NO-106      AAYHMQQQQQ QQQHPNHSA AMDCE---PTL QIGYPHQFA APDQVANNIP   246
GI-47681319-SEQ-ID-NO-107      AAYH------ EQQPPHSA ALDCEP--PTL QIGYPHQ-FM PPE--AANIP   232
GI-50251892-SEQ-ID-NO-108      AIV------- QPPPHSA AMDSE---PTL QIGYPHQ-FV PAE--ANTLQ   232
```

Figure 1 - continued

| | | |
|---|---|---|
| ANNOT-1524415-SEQ-ID-NO-100 | A E K S MPD E T — — NFF Q GWI L | 245 |
| CLONE-241491-SEQ-ID-NO-96 | — — — — — — — T — VF YTRLC Q | 166 |
| GI-36888591-SEQ-ID-NO-105 | RSSAPGG — EN NFMLGWVL | 258 |
| GI-44888603-SEQ-ID-NO-106 | RSSAPGG — EN NFMLGWVL | 263 |
| GI-47681319-SEQ-ID-NO-107 | RSAPAGG — EN NFMLGWVL | 249 |
| GI-50251892-SEQ-ID-NO-108 | RSTAPAGA EN NFMLGWVL | 250 |

Figure 2

| | | | | | | |
|---|---|---|---|---|---|---|
| CLONE-246416-SEQ-ID-NO-140 | MGRGPVQLRR | ENKINRQVT | FSKRRNGLLK | KAHEI SVLCD | AEVALI VFST | 50 |
| ANNOT-1511886-SEQ-ID-NO-144 | MGRGRVQLKR | ENKINRQVT | FSKRRTGLLK | KAHEI SVLCD | AEVALI VFSH | 50 |
| CLONE-39890-SEQ-ID-NO-148 | MGRGRVQLKR | ENKINRQVT | FSKRRAGLLK | KAHEI SVLCD | AEVALVVFSH | 50 |
| CLONE-467075-SEQ-ID-NO-150 | MGRGRVQLKR | ENKINRQVT | FSKRRSGLLK | KAHEI SVCD | ADVALI VFST | 50 |
| GI-50939129-SEQ-ID-NO-160 | MGRGPVQLRR | ENKINRQVT | FSKRRNGLLK | KAHEI SVLCD | AEVALI VFST | 50 |
| GI-58422998-SEQ-ID-NO-161 | MGRGKYQLKR | ENKINRQVT | FSKRRSGLLK | KAHEI SVLCD | AEVGLI I FST | 50 |
| | | | | | | |
| CLONE-246416-SEQ-ID-NO-140 | KGKLYEYSSH | SSMEGLERY | QRYSFEERAV | ELQLEDQAN | WGDEYVRLKS | 100 |
| ANNOT-1511886-SEQ-ID-NO-144 | KGKLFEYSTN | ACMEKI LERH | ERYSYAEROL | VATDLDSQGN | WTLEYNRLKA | 100 |
| CLONE-39890-SEQ-ID-NO-148 | KGKLFEYSTD | SCMEKI LERY | ERYSYAEROL | APESDVNTN | WSMEYNRLKA | 100 |
| CLONE-467075-SEQ-ID-NO-150 | KGKLFEYSSD | PCMEKI LERY | ERYSYAEROL | VASDQPLTEN | WTLEHAKLKA | 100 |
| GI-50939129-SEQ-ID-NO-160 | KGKLYEFSSH | SSMEGLERY | QRYSFDERAV | LEPNTEDQEN | WGDEYGIKS | 100 |
| GI-58422998-SEQ-ID-NO-161 | KGKLYEFSTF | SCMDKI LERY | ERYSYAEKVL | VSSESEI QGN | WCHEYRKLKA | 100 |
| | | | | | | |
| CLONE-246416-SEQ-ID-NO-140 | KLDAQKSQR | QLL | GEQISLTTK | ELQLEQQLD | SSLKHI RSRK | 143 |
| ANNOT-1511886-SEQ-ID-NO-144 | KVELLQRNHR | HYL | GEDLDSVSLK | ELQNLEQQI D | TALKHI RERK | 143 |
| CLONE-39890-SEQ-ID-NO-148 | KI ELLERNQR | HYL | GEDLQAMSPK | ELQNLEQQLD | TALKHI RTRK | 143 |
| CLONE-467075-SEQ-ID-NO-150 | RLEVLQKNQR | VCLLFCRNFM | GQDLEGI STK | ELQNLEHQLE | SALKHI RSRK | 150 |
| GI-50939129-SEQ-ID-NO-160 | KLDAQKSQR | QLL | GEQIDTLTI K | ELQQLEHQLE | YSLKHI RSKK | 143 |
| GI-58422998-SEQ-ID-NO-161 | KVETQKQK | HLM | GEDLESLNLK | ELQQLEQQLE | SSLKHI RSRK | 143 |
| | | | | | | |
| CLONE-246416-SEQ-ID-NO-140 | NQLMFDSI SA | QKKEKALTD | QNGVLQKFME | AEKEKQNKAL | MNAQLRECQ— | 191 |
| ANNOT-1511886-SEQ-ID-NO-144 | NHLMYQSI SE | QDKKEKAI KE | QNNMLVKQI — | —KEKEKAL | AQPALVDQQ— | 188 |
| CLONE-39890-SEQ-ID-NO-148 | NQLMYESI NE | QKKEKAI QE | QNSMLSKQI — | —KEREKQ | AQQEQMDCHR | 189 |
| CLONE-467075-SEQ-ID-NO-150 | NQLMYESI SE | HKKDKALQE | QNNMLSKKI — | —KEKEKAL | AQQAQLERLG | 196 |
| GI-50939129-SEQ-ID-NO-160 | NQLLFESI SE | QKKEKSLKN | QNNVLQKLME | TEKEKNNAI — | I NTNREECN— | 191 |
| GI-58422998-SEQ-ID-NO-161 | NQLMHESI SE | QKKERSLOE | ENKVLQKEL | VEKQKAHV | AQODOI —CP— | 188 |
| | | | | | | |
| CLONE-246416-SEQ-ID-NO-140 | NGASTSSPSL | SPPI VPD— | ——— | SMPTLNI GP— | CHRGAAESE | 227 |
| ANNOT-1511886-SEQ-ID-NO-144 | DHGPNASS— | FLLPQ——— | ——P | PLPCLNI SY— | QE——— | 213 |
| CLONE-39890-SEQ-ID-NO-148 | NQGHNMPP— | PLEPQQHQ | I QHPYMLSHQ | PSPFLNMG— | CLYQE | 228 |
| CLONE-467075-SEQ-ID-NO-150 | DEVDLTSS— | ALVPQ——— | ——— | PLVTSNI RTS | SCI RGEGDNE | 229 |
| GI-50939129-SEQ-ID-NO-160 | GATPSTSS—P | TPVTAPD— | ——— | PI PTTNNSQ— | SCPRGSGESE | 226 |
| GI-58422998-SEQ-ID-NO-161 | QTESSSSS— | FMLRD——— | ——— | APPAANTS— | HPAATGERA | 219 |

Figure 2 - continued

| | | | | |
|---|---|---|---|---|
| CLONE-246416-SEQ-ID-NO-140 | SEPSPAPA QA | NRGN PPW | —MLRIT —VK | 251 |
| ANNOT-1511886-SEQ-ID-NO-144 | EDPEARRNYE | LDLT EPI YS | CHL GCFGT | 241 |
| CLONE-39890-SEQ-ID-NO-148 | DDPMAMRRND | LELT EPVYN | CNL GCFAA | 256 |
| CLONE-467075-SEQ-ID-NO-150 | —GI PTPT QA | —NA PPW | —MLRPTNE | 251 |
| GI-50939129-SEQ-ID-NO-160 | —AQPSPA QA | GNSKL PPW | —MLRIT SHT | 249 |
| GI-58422998-SEQ-ID-NO-161 | EDAAVQP DAP | PRIG PPW | —MVSHI NG | 244 |

Figure 3

| | | | | | | |
|---|---|---|---|---|---|---|
| CLONE:1010174-SEQ-ID-NO-196 | M-FPHERKKE | KERSQGFYLV | TRLRI RMGRG | KI EI KRI ENS | TNRQVTFCKR | 50 |
| ANNOT-1540248-SEQ-ID-NO-198 | ---------- | ---------- | -----MGRG | KI EI KRI ENT | TNRQVTFCKR | 24 |
| CLONE-1044034-SEQ-ID-NO-204 | ---------- | ---------- | -----MGRG | KI EI KRI ENT | TNRQVTFCKR | 24 |
| GI-399096-SEQ-ID-NO-207 | ---------- | SS-------- | -PQRKA GRG | KI EI KRI ENT | TNRQVTFCKR | 40 |
| GI-886405-SEQ-ID-NO-208 | MAYQMELGGE | ---------- | -----MGRG | KI EI KRI ENT | TNRQVTFCKR | 24 |
| GI-24636577-SEQ-ID-NO-209 | MVKESASPGS | GSGSPG---- | -GAAEKMGRG | RI EI KRI ENT | TNRQVTFCKR | 45 |

| CLONE:1010174-SEQ-ID-NO-196 | RNGLLKKAYE | SVLCDAEVA | I VFSTRGRL | YEYANNNI RS | TI ERYKKACS | 100 |
|---|---|---|---|---|---|---|
| ANNOT-1540248-SEQ-ID-NO-198 | RNGLLKKAYE | SVLCDAEVS | I VFSSRGRL | YEYANNNI RS | TI DRYKKV SS | 74 |
| CLONE-1044034-SEQ-ID-NO-204 | RNGLLKKAYE | SVLCDAEVA | I VFSSRGRL | YEYSNNNI RS | TI ERYKKACS | 74 |
| GI-399096-SEQ-ID-NO-207 | RNGLLKKAYE | SVLCDAEVA | I VFSSRGRL | YEYSNNSVKG | TI ERYKKA S | 90 |
| GI-886405-SEQ-ID-NO-208 | RNGLLKKAYE | SVLCDAEVA | I VFSSRGRL | YEYANNSVKS | TVERYKKANS | 74 |
| GI-24636577-SEQ-ID-NO-209 | RNGLLKKAYE | SVLCDAEVA | I VFS GRGRL | YEYSNNSVKA | TI ERYKKATS | 95 |

| CLONE:1010174-SEQ-ID-NO-196 | DSTNT VCE | NAA YYQOES | AKLRQQI QT | QNSN RNLMG | DSLSSLSVKE | 149 |
|---|---|---|---|---|---|---|
| ANNOT-1540248-SEQ-ID-NO-198 | DSSNTASI E | NAQYYQOES | AKMRQQI Q | QNSN RHLMG | EAVS LSVKE | 123 |
| CLONE-1044034-SEQ-ID-NO-204 | D SSASTL | NAQYYQOES | AKLRQQI QM | QNSN RHLMG | DALSTLTVKE | 123 |
| GI-399096-SEQ-ID-NO-207 | DNSNTGSVAE | NAQYYQOES | SKLRQQI S | QNANGRI YG | ETI GSMS KE | 139 |
| GI-886405-SEQ-ID-NO-208 | DTSNSGTVAE | VNAQHYQOES | AKI SSL | QNSN RTLI G | DSI NTMSLRD | 124 |
| GI-24636577-SEQ-ID-NO-209 | DTSSAGTVAE | NAQHYQOES | AKLKQQI TTL | QNSN | DTMATMS RD | 144 |

| CLONE:1010174-SEQ-ID-NO-196 | KQVENRLEK | A SRI RSKKH | ELLL ET ENA | QKRET ELDNE | NI YLRTKVAE | 199 |
|---|---|---|---|---|---|---|
| ANNOT-1540248-SEQ-ID-NO-198 | KQLENRLER | GMTRI RSKKH | ELLLAEI EYM | QKREI ELENE | SAC RTKI AE | 173 |
| CLONE-1044034-SEQ-ID-NO-204 | LKQLENRLER | GI TRI RSKKN | EMLLAEI EYE | QKREI ELENE | NL LRTKI D | 173 |
| GI-399096-SEQ-ID-NO-207 | LR EGRLDR | SV RI RARKN | ELL AEI DYM | QKREVDLHND | NQLI RAKI AE | 189 |
| GI-886405-SEQ-ID-NO-208 | LKQVENRLEK | G AKI RARKN | ELLY AEVEYN | QKREVELOND | NMYLRSKV E | 174 |
| GI-24636577-SEQ-ID-NO-209 | LKQLE GRLDK | GL KI RARKN | ELL CAEI EYM | QRREMELQ N | NFFLREKVAE | 194 |

| CLONE:1010174-SEQ-ID-NO-196 | VERYQQH-H | QMVSG-S | E NAI | EA-LASR | NYFFAHSI MT A | 235 |
|---|---|---|---|---|---|---|
| ANNOT-1540248-SEQ-ID-NO-198 | VERLQQA-N | MVTG-E | ELNAI | QALAASR | NFFFAPHE EG | 208 |
| CLONE-1044034-SEQ-ID-NO-204 | VERI QQV-N | MVSG-P | ELNAI | QA-LASR | NFFNPNMLEG | 207 |
| GI-399096-SEQ-ID-NO-207 | NERNNPS-MS | LME GG-S | NYEQI MPPPQ | TOPQP-FDSR | NYFQVAA QP | 233 |
| GI-886405-SEQ-ID-NO-208 | NERGQOP-L N | MMGAAS TS- | EYDHMV | -NNP-YDSR | NFL DVNI MQQ | 214 |
| GI-24636577-SEQ-ID-NO-209 | TERGQQQT L N | MMGAAS SN | EYEQNM | H-CDFR | TEL QFNF MQQ | 235 |

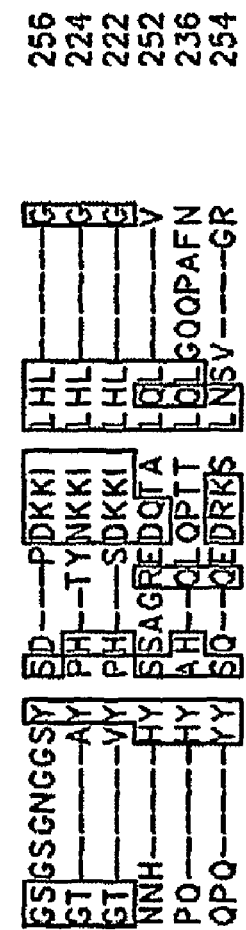
Figure 3 - continued

Figure 4

| | | | | | |
|---|---|---|---|---|---|
| CLONE-22339-SEQ-ID-NO-238 | MEEGGSSHDA | ESSKKLGRGK | EIKRIENTT | NRQVTFCKRR | NGLLKKAYEL | 50 |
| ANNOT-1139571-SEQ-ID-NO-240 | MAYQNEPQES | SPLRKLGRGK | VEIKRIENTT | NRQVTFCKRR | NGLLKKAYEL | 50 |
| CLONE-103400-SEQ-ID-NO-244 | MEGGASNEVA | ESSKKIGRGK | EIKRIENTT | NRQVTFCKRR | NGLLKKAYEL | 50 |
| CLONE-1043518-SEQ-ID-NO-250 | MFDPNQAQEG | SSQKKMGRGK | EIKRIENTT | NRQVTFCKRR | NGLLKKAYEL | 50 |
| GI-1001935-SEQ-ID-NO-251 | | MGRGR | EIKRIENTI | GRQVTFCKRR | NGLLKKAYEL | 35 |
| GI-19698536-SEQ-ID-NO-252 | | MGRGR | EIKRIENTI | NRQVTFCKRR | NGLLKKAYEL | 35 |
| GI-50902252-SEQ-ID-NO-253 | | MGRGK | EIKRIENKT | SRQVTFCKRR | NGLLKKAYEL | 35 |

| | | | | | | |
|---|---|---|---|---|---|---|
| CLONE-22339-SEQ-ID-NO-238 | SVLCDAEVAL | VIFSTRGRLY | EYAN-NSVRG | TIERYKKACS | DAVNP-PGVT | 98 |
| ANNOT-1139571-SEQ-ID-NO-240 | SVLCDAEVAL | VFSSRGRLY | EYSN-NSVKS | TIERYKKACA | DSSNN-GSVS | 98 |
| CLONE-103400-SEQ-ID-NO-244 | SVLCDAEVAL | VIFSTRGRLY | EYAN-NSVRG | TIERYKKACS | DAVNP-PTIT | 98 |
| CLONE-1043518-SEQ-ID-NO-250 | SVLCDAEVAL | VVFSTRGRLY | EYAN-NSVRA | TIERYKKANA | AASNA-ESVS | 98 |
| GI-1001935-SEQ-ID-NO-251 | SVLCDAEVAL | VVFSSRGRLY | EYSN-NSVKA | TIERYKKAHA | VGDSSSGPPL | 84 |
| GI-19698536-SEQ-ID-NO-252 | SVLCDAEVAL | VVFSSRGRLY | EYSN-NSVKA | TIERYKKANS | -DTSNS-CIVA | 83 |
| GI-50902252-SEQ-ID-NO-253 | AILCDAEIAL | VFSSRGRLY | EFSNMNSTRS | TIERYKKASA | STSGS-APV | 84 |

| | | | | | | |
|---|---|---|---|---|---|---|
| CLONE-22339-SEQ-ID-NO-238 | EANT-QYYQQ | EASKLRRQIR | DIQNSN--RHI | VGESLGSLNF | KELKNLEGRL | 146 |
| ANNOT-1139571-SEQ-ID-NO-240 | EANA-QFYQQ | EAAKLRRQIR | NLQNSN--RNM | LGESLGSLNE | KELKNLESRL | 146 |
| CLONE-103400-SEQ-ID-NO-244 | EANT-QYYQQ | EASKLRRQIR | DIQNQN--RHI | GESLGSLSL | KELKNLEGRL | 146 |
| CLONE-1043518-SEQ-ID-NO-250 | EANT-QFYQQ | ESSKLRRQIR | DIQNLN--RHL | GEALGSLSL | KELKNLEGRL | 146 |
| GI-1001935-SEQ-ID-NO-251 | EFNA-QQFYQQ | ESVKLRRQNQ | MQNTN--RHL | VGDSVGNLSL | RDLKQLEGRL | 133 |
| GI-19698536-SEQ-ID-NO-252 | EVNA-QYYQQ | ESSKLRQQIS | SLQNSNSRGL | VRDSVSTMTL | KELKSLENRL | 132 |
| GI-50902252-SEQ-ID-NO-253 | DVNSHQYFQQ | EAAKMRHQIQ | TLQNAN--RHL | GESIGNMTA | KELKSLENRL | 133 |

| | | | | | | |
|---|---|---|---|---|---|---|
| CLONE-22339-SEQ-ID-NO-238 | EKGISRVRSK | KNELLVAEIE | YMQKR---EME | QHNNMYLRA | KIAEGARL-NP | 194 |
| ANNOT-1139571-SEQ-ID-NO-240 | EKGIGRIRSK | KNELLFAEIE | YMQKR---EID | HNNNQL-RA | KIAENERKR- | 193 |
| CLONE-103400-SEQ-ID-NO-244 | EKGISRVRSK | KHEMLFAEIE | YMQKRVKEIE | QNDNMYLRS | KITERTGLQ- | 195 |
| CLONE-1043518-SEQ-ID-NO-250 | EKGLSRVRSR | KHETLFADVE | FMQKR---EE | QNDNNYLRA | KIAEHERAQ- | 193 |
| GI-1001935-SEQ-ID-NO-251 | EKGISKIRAR | KSELLAAEIN | YMAKR---ETE | QNDHMN-RT | KIEEGEOOL- | 180 |
| GI-19698536-SEQ-ID-NO-252 | EKGIAKIRSK | KNELMYAEVE | YMQKR---EME | HNDNIYLRS | KVSENERG- | 179 |
| GI-50902252-SEQ-ID-NO-253 | EKGISRIRSK | KHELLFSEIE | YMQKR---EAD | QNENMFLRA | KVAEAERAE- | 180 |

```
                                                                                                    41
                                                                                                    42
                                                                                                    30
                                                                                                    31
                                                                                                    32
CLONE:1603950-SEQ-ID-NO:293  M     TKERW QSAL  TNDELVADLL  RLKQHSSDL  DSDSLLI KKT
GI:42573123-SEQ-ID-NO:296    P     AKDDWVAVAI  TDDDLVVELL  RLKHAGI    ---VVSD
CLONE:13660-SEQ-ID-NO:285    MV    SSDDWI RCAM  RDGEVVAELL  VKLKEA    ---KV
ANNOT-1508840-SEQ-ID-NO:287  ---   -MEEWVI AAM  ADETVVAKLL  RLKQSQA   ---TASA
CLONE:745881-SEQ-ID-NO:291   MV    NEDEWVRAAM  ADDI VVVELL  RLKQG     ---TVSH 73
                                                                                                    83
                                                                                                    58
                                                                                                    81
                                                                                                    68
CLONE:1603950-SEQ-ID-NO:293  VDTTI VPPC   WGNRKI RSKS  TAVVKGFGK-   ---         EHR
GI:42573123-SEQ-ID-NO:296    NPAVI LPPLR  WGI RQRSRS  SRFGGGGGVL  VSLKKDVD     SMR
CLONE:13660-SEQ-ID-NO:285    I KNPI VTALR  WGI QQPRSRC  PRKES       ---         EISR
ANNOT-1508840-SEQ-ID-NO:287  SAVPAVI PLR   WGMRI PRSRP  GT MTATNSSS  LRCDVV KSK  ESR
CLONE:745881-SEQ-ID-NO:291   KSHHQLI PFS   WGVKQPRSRS  RLSAAVS     ---RCDAAV   STR 115
                                                                                                    131
                                                                                                    108
                                                                                                    130
                                                                                                    106
CLONE:1603950-SEQ-ID-NO:293  GSPTTHLSWS  GGGGSSSDCS  RP--SDMSSG  QRSVKANEGP  SI SSI
GI:42573123-SEQ-ID-NO:296    ASPKI TPLSWS GGGSGGGSA  SPSADGFEDN  SRQ--ASCBI  ST GSGSKVFP
CLONE:13660-SEQ-ID-NO:285    CSPSTPLSWS  GCCGGGSSSP  SGYVDGYEAI  SRQI SAVGBR  SKNI SSLRSP
ANNOT-1508840-SEQ-ID-NO:287  CSFTTPLSWS  GGI SDGGASP  SGT GDGFEET  SRRHLSSSPP  PPGVRSKGAG
CLONE:745881-SEQ-ID-NO:291   CSPTTPLSWS  AGI       DSI EDS     SRHHHHAEI  SKATATSGY- 139
                                                                                                    179
                                                                                                    133
                                                                                                    178
                                                                                                    152
CLONE:1603950-SEQ-ID-NO:293  ---         RNKMRK      FELKNEEN LK  KERI DI EKV   MELCSEKAEI
GI:42573123-SEQ-ID-NO:296    YNN---DQNH   SKRLKKRKSI              DFRCYSI EI Y
CLONE:13660-SEQ-ID-NO:285    TNE---TSCF   LKRMK       SELKEEETQL  VKEGVI LKKE   MNI QNLAKD
ANNOT-1508840-SEQ-ID-NO:287  FSERGI ENNN VKRSRKKKT  AELKEEESSL  LKESI YLKKE   I ST VRAI FKE
CLONE:745881-SEQ-ID-NO:291   I GE---TT SNI KRCRRKKT                          I AT VNANFEA
                             T GN---SASI 144
                                                                                                    184
                                                                                                    138
                                                                                                    183
                                                                                                    202
CLONE:1603950-SEQ-ID-NO:293  EGPI ER       ---
GI:42573123-SEQ-ID-NO:296    HCFHC        ---
CLONE:13660-SEQ-ID-NO:285    ENCKI        ---         ---         ---         ---
ANNOT-1508840-SEQ-ID-NO:287  ERARN        ---
CLONE:745881-SEQ-ID-NO:291   QRAKNESLKR  MKLDVGLKYH  QNNPSSTSVE  PQCVLAGQPH  QRI VVSSEAL 160
                                                                                                    198
                                                                                                    163
                                                                                                    187
                                                                                                    245
CLONE:1603950-SEQ-ID-NO:293  ---
GI:42573123-SEQ-ID-NO:296    ---                                   GEV        PDLNMT PNE  DDM
CLONE:13660-SEQ-ID-NO:285    ---                                              KKTQYFSI G  DCK
ANNOT-1508840-SEQ-ID-NO:287  ---         ---         ---DGNEI      LPDLNI VCD  ENSDHYTSLG
CLONE:745881-SEQ-ID-NO:291   I RPI QDDTHS  HASESRPNKI  ESTTCKSFEI             ---EI      NLK
                                                                              PDLNMPSEI   DVS
```

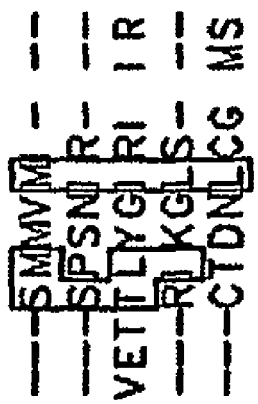
Figure 5 - continued

Figure 6

| Clone | Sequence | | | | Pos |
|---|---|---|---|---|---|
| CLONE-617383-SEQ-ID-NO-311 | MVKTA | — | — | QQLGGKMRT | 28 |
| GI-50913131-SEQ-ID-NO-316 | MVKSGQEAAP | G | — AAG | ARQGGGGGR | 33 |
| CLONE-325346-SEQ-ID-NO-309 | VKT | — | — ATA | G | 20 |
| CLONE-708396-SEQ-ID-NO-299 | MVKNEHKI KT | E | —PSSKAMRLS | TAAARHGAH | 33 |
| ANNOT-1443312-SEQ-ID-NO-301 | MVKSEHRI QS | E | — TFT | SFSSSTSDCK | 27 |
| ANNOT-1505156-SEQ-ID-NO-305 | MVKQELKI QV | — | —ASKPVA | PMPT SSSACK | 31 |
| CLONE-231890-SEQ-ID-NO-320 | MVKQERKI QT | TTS | —SSSLSHSSS | SSTPSPSACK | 42 |
| CLONE-19721-SEQ-ID-NO-307 | MVKQERKI QT | SSTKKEMPLS | SSPSSSSSSS | HQSCKNKI KK | 50 |
| CLONE-100156-SEQ-ID-NO-322 | MVKQERKI QT | SSTKKEMPLS | —SSPSSSSSSS | NKNKKSKI KK | 49 |

| Clone | Sequence | | | | Pos |
|---|---|---|---|---|---|
| CLONE-617383-SEQ-ID-NO-311 | YKGVRMRSWG | AWSEI RAPG | QKTRI WLGSH | DAALLCLKGA | 78 |
| GI-50913131-SEQ-ID-NO-316 | YKGVRMRSWG | SWVSEI RAPN | QKTRI WLGSY | DAALLCLKGS | 83 |
| CLONE-325346-SEQ-ID-NO-309 | YKGVRMRSWG | SWVSEVRAPG | QKTRI WLGSH | DAALLCLRGS | 70 |
| CLONE-708396-SEQ-ID-NO-299 | YKGVRMRSWG | SWVSEI RAPN | QKTRI WLGSY | DAALLCLKGS | 83 |
| ANNOT-1443312-SEQ-ID-NO-301 | YKGVRMRSWG | SWVSEI RAPG | QKTRI WLGSY | DAALLCLKGS | 77 |
| ANNOT-1505156-SEQ-ID-NO-305 | YKGVRMRSWG | SWVTEI RAPN | STPEAAARAY | DAALLCLKGS | 81 |
| CLONE-231890-SEQ-ID-NO-320 | YKGVRMRSWG | SWVSEI RAPN | STAEAAARAX | DAALFCLKGS | 79 |
| CLONE-19721-SEQ-ID-NO-307 | YKGVRMRSWG | SWVSEI RAPN | STAEAAARAY | DVALLCLKGP | 100 |
| CLONE-100156-SEQ-ID-NO-322 | YKGVRMRSWG | SWVSEI RAPN | STAEAAARAY | DVALLCLKGP | 99 |

| Clone | Sequence | | | | Pos |
|---|---|---|---|---|---|
| CLONE-617383-SEQ-ID-NO-311 | SAAADLNFPV | RFPFDL | PAAAMSP | AAGASANVFD | 121 |
| GI-50913131-SEQ-ID-NO-316 | A—ADLNFPV | HLPFF | PAAAMSP | AA— NAT | 119 |
| CLONE-325346-SEQ-ID-NO-309 | AAAPDLNFPL | RRPLADGLHP | PPAAMSP | AA—CCAPQSN | 117 |
| CLONE-708396-SEQ-ID-NO-299 | S—ANLNFPL | SSSQQY | L—PGDAVMSP | AN—SFID | 122 |
| ANNOT-1443312-SEQ-ID-NO-301 | A—ANLNFPI | TSSHY | —PDAVMSP | AN—SSED | 114 |
| ANNOT-1505156-SEQ-ID-NO-305 | AA—NLNFPI | TSSHY | PDTVMSP | AN—SFVQ | 118 |
| CLONE-231890-SEQ-ID-NO-320 | Q—ANLNFPT | SSSSRHLLDN | LLDENT LSP | AN—SF | 79 |
| CLONE-19721-SEQ-ID-NO-307 | Q—ANLNFPT | SSSSHHLLDN | LLDENT LSP | AN—SF | 142 |
| CLONE-100156-SEQ-ID-NO-322 | | | | | 141 |

| Clone | Sequence | | | | Pos |
|---|---|---|---|---|---|
| CLONE-617383-SEQ-ID-NO-311 | FAAADDSASA | DDSASAVTPE | YCSSSSNASP | V | 160 |
| GI-50913131-SEQ-ID-NO-316 | SPLQHHSGAP | SFATATGGYN | SYGDWSCSA | V | 160 |
| CLONE-325346-SEQ-ID-NO-309 | GI GSACCAAP | CAPPSNGI GS | GSPPSSDS | DVSSPEAGST | 167 |
| CLONE-708396-SEQ-ID-NO-299 | NATI TP | P—SPPPAS—TP | LVSSPSD—QI | D | 156 |
| ANNOT-1443312-SEQ-ID-NO-301 | NPTTP | PLPSSS—SS | MVSSPSD—QP | D | 152 |
| ANNOT-1505156-SEQ-ID-NO-305 | NPTTP | PLP—CS—SS | VVSSPSD—QL | D | 156 |
| CLONE-231890-SEQ-ID-NO-320 | Q | — | — | — | 79 |
| CLONE-19721-SEQ-ID-NO-307 | NHFAPT SSAV | DH | LMGS | FV | 175 |
| CLONE-100156-SEQ-ID-NO-322 | NHFAPT SSAV | DHHHDDGMQS DHHHDDGMQS | LMGS | FV D | 174 |

Figure 6 - continued

| | | | | | | | |
|---|---|---|---|---|---|---|---|
| CLONE-617383-SEQ-ID-NO:311 | ---SSPETASS | GGADL-DGVDL | LGYGYS--QC | SLAEL EAFFQ | SPKCMEYAMM | 206 |
| GI:50913131-SEQ-ID-NO:316 | ---SSPETANY | YGAD-DMVAR | EDDVD---YA | ALADI DAFFQ | SPKCMDYSMM | 205 |
| CLONE-325346-SEQ-ID-NO:309 | ASSDGE-ARY | GDGDGDGGVS | VDYGSLADI D | AFFQSPKCMD | DDHYYXAAL M | 217 |
| CLONE-708396-SEQ-ID-NO:299 | ---DDALL-TSS | FQAYTSCGQA | NQSMAVNVME | PWYT FGDG Q | SPKYADQML- | 203 |
| ANNOT-1443312-SEQ-ID-NO:301 | ---DYMSL MES | FETDNEPI PM | ---------LD | SWYNF-DG Q | SPKYI DQMF- | 190 |
| ANNOT-1505156-SEQ-ID-NO:305 | ---DYISL MES | FETNNEPVSM | ---------LD | SWYNF-DG L Q | SPKYLD---- | 192 |
| CLONE-231890-SEQ-ID-NO:320 | | | | | | 79 |
| CLONE-19721-SEQ-ID-NO:307 | ---NHVSL MDS | | ---------TS | SWYDDHNGM- | ----FL | 196 |
| CLONE-100156-SEQ-ID-NO:322 | ---NHVSL MDS | | ---------TS | SWYDDHNGM- | ----FL | 195 |

| | | | | | | | |
|---|---|---|---|---|---|---|---|
| CLONE-617383-SEQ-ID-NO:311 | DPCSTFF APA | P---------- | EDECSWEEGG | DI AL WSY-- | -------- | 237 |
| GI:50913131-SEQ-ID-NO:316 | DPCSTFF SPA | P---ESL | AAE---WEDEG | EI SL WSFSSL | N------- | 238 |
| CLONE-325346-SEQ-ID-NO:309 | DPCGAFF APA | PSVAADDDAA | AAAGCWEDGD | GI AL WSFSFP | ALDC | 261 |
| CLONE-708396-SEQ-ID-NO:299 | SGDFF HVD | S---SHL | DD-LY--EES | DI RL WSFC | -------- | 231 |
| ANNOT-1443312-SEQ-ID-NO:301 | NGVSFNPP | M---------- | DD-FY---EG | DI RL WSFAE | -------- | 215 |
| ANNOT-1505156-SEQ-ID-NO:305 | NWVSFNPP | M---------- | DD-LY---EG | DLRL WSFAE | -------- | 217 |
| CLONE-231890-SEQ-ID-NO:320 | | | | | | 79 |
| CLONE-19721-SEQ-ID-NO:307 | FDNGAPF NYS | PQL---NSTT M | LDE-YFYEDA | DI PL WSFN- | -------- | 231 |
| CLONE-100156-SEQ-ID-NO:322 | FDNGAPF NYS | PDL---NSTT M | LDE-YFYEDA | DI PL WSFN- | -------- | 230 |

Figure 7

```
ANNOT-543998-SEQ-ID-NO-327                                              MIPY GHNSY         QQ HQFFLPEME-     21
CLONE-445231-SEQ-ID-NO-333    MMAGAPPMHI CLDSDWLKGI VPEEP-GMGS SSPSAEL-  A  CPRPMHATAA--    48
CLONE-770468-SEQ-ID-NO-336               -MDSDWLKGI VPEDQGGMGS SSPSGELI A  CPEPMQAQQ--     38
ANNOT-1467548-SEQ-ID-NO-331                -DTATQWAQGI GAVNP    ME GSRPD-            23
CLONE-1361038-SEQ-ID-NO-338              -------M     EGMAP    NS CARP-             12
CLONE-1371374-SEQ-ID-NO-340              -------M     EGMAP    NS CARP-             12

ANNOT-543998-SEQ-ID-NO-327    IPEKWKLSYE QEA-TAPACP RCASSNTKFC YNNYSLSQP RYFCKGCRRY    71
CLONE-445231-SEQ-ID-NO-333    AADRRLRPQH DQPLK---CP RCESTHTKFC YNNYSLSQP RYFCKTCRRY    95
CLONE-770468-SEQ-ID-NO-336    AADRRLRPQH DQPLK---CP RCDSTHTKFC YNNYSLSQP RYFCKTCRRY    85
ANNOT-1467548-SEQ-ID-NO-331   VLERRARPDK DQALN---CP RCNSTNTKFC YNNYSLSQP RYFCKTCRRY    70
CLONE-1361038-SEQ-ID-NO-338   VLEKKTRPQE D-------CP RCNSTNTKFC YNNYSLTQP RYFCKTCRRY    57
CLONE-1371374-SEQ-ID-NO-340   VLEKKTRPQE D-------CP RCNSTNTKFC YNNYSLTQP RYFCKTCRRY    57

ANNOT-543998-SEQ-ID-NO-327    WTKGGSLRNI PVGGGCRKRS RSRQNSHK--- ---------- -RFGR       103
CLONE-445231-SEQ-ID-NO-333    MTKGGSLRNV PVGGGCRKNK RASAKKPPA-- PP-------- ----        127
CLONE-770468-SEQ-ID-NO-336    MTKGGSLRNV PVGGGCRKNK RASAKKPSA-- PP-------- ----        127
ANNOT-1467548-SEQ-ID-NO-331   MTAGGSLRNV PVGGGSRKNK RSSSTASTSA AGAAASKKFP SNMQ         120
CLONE-1361038-SEQ-ID-NO-338   MTEGGSLRNV PVGGGSRKNV KVSVTASSSS SPKVPDLNPP DLTDPNLPH    105
CLONE-1371374-SEQ-ID-NO-340   MTEGGSLRNV PVGGGSRKNV KVSVTASSSS SPKVPDLNPP NLS-SVSA     105

ANNOT-543998-SEQ-ID-NO-327    NENRPDGLIN QDDGFQSSPP GSD DLAAVF AQPVT-     DRSPSSTDNT       148
CLONE-445231-SEQ-ID-NO-333    OPELHMSE    TG---HLSFS GVQQ---LPPA DPLCS-GLLD WKYDPILTGS     170
CLONE-770468-SEQ-ID-NO-336    QLHGRHMAE   TG---HLSFS GMQPPAVSAA DPLCS-GLFD WKYDH--LSGS   175
ANNOT-1467548-SEQ-ID-NO-331   SASQNPKI    EGQDLNLAYP PSAD--DYSN SEFVEIP-FD TESNKTHHQN    167
CLONE-1361038-SEQ-ID-NO-338   ISSQNPKIMH GGQDLNLAFP AMEK-YHGM PPYVEMQNSD TTT-HHHQT     154
CLONE-1371374-SEQ-ID-NO-340   ISSQNPKIMH GGQDLNLAFP AMEK-YHGM PPYVEMQNSD TTT-HHHQT     154

ANNOT-543998-SEQ-ID-NO-327    GSDQDSP T   TTTHALESLS W-D CQETDV DLGFYGEFNN LTQKIKEDQE     197
CLONE-445231-SEQ-ID-NO-333    GCVAGSLDGA  SSETHFAGTG MLGI PGAS  GGGECHALSA LR             210
CLONE-770468-SEQ-ID-NO-336    GGFESANSEA  ---HFT GPG MMGI ANGGG GGAEYHALNA LR             213
ANNOT-1467548-SEQ-ID-NO-331   PNPSSTSPSH HHHHHVSPME FLKST AMNSR GFSAFM--S PPLEDSNNT       214
CLONE-1361038-SEQ-ID-NO-338   SSSCSAPPAS --LSALE     LLR SSMASR GLNPYAPSES LMPNSTNSNA    198
CLONE-1371374-SEQ-ID-NO-340   SSSCSAPPAS --LSALE     LLR SSMASR GLNPYAPSES LMPNSTNSNA    198
```

| | | | | | | |
|---|---|---|---|---|---|---|
| ANNOT-555366-SEQ-ID-NO-342 | FGRCPRVFCC | GQSCLPVGQS | DI PRSSTVKI | YCPKCEDI YY | PRSKYQGNI D | 242 |
| CLONE-1222371-SEQ-ID-NO-381 | FGRCPRVFCC | GQSCLPVGQS | DI PRSSTVKI | YCPKCEDI YY | PRSKFQGNI D | 236 |
| CLONE-702573-SEQ-ID-NO-379 | FGRCPRVYCC | GQPCLPVGQS | DI HRSSTVKI | YCPKCEDI YY | PRSKYQGNI D | 229 |
| GI-34901776-SEQ-ID-NO-382 | FGRCPRVYCC | GQPCLPVGQS | DI HRSSTVKI | YCPKCEDI YY | PRSKYQGNI D | 248 |
| ANNOT-1486236-SEQ-ID-NO-366 | FGRCPRVYCC | GQPCLPVGQS | DI PRSSTVKI | YCPKCEDI YY | PRSKYQGNI D | 285 |
| CLONE-535483-SEQ-ID-NO-377 | FGRCPRVYCS | GQPCLPVGQS | DI PRSSTVKI | YCPRCEDLYY | PRSKYQGNI L | 221 |

| | | | | | |
|---|---|---|---|---|---|
| ANNOT-555366-SEQ-ID-NO-342 | GAYFGTTFPH | LFLMAYGNMK | PQKPAQNYVP | KI FGFKVHN- | RQ | 283 |
| CLONE-1222371-SEQ-ID-NO-381 | GAYFGTTFPH | LFLMTYGNLK | PQKPTQSYVP | KI FGFKVH-- | KP | 276 |
| CLONE-702573-SEQ-ID-NO-379 | GAYFGTTFPH | LFLMTYDHLK | PQKPSQRYVP | RVFGFKLHNH | KP | 271 |
| GI-34901776-SEQ-ID-NO-382 | GAYFGTTFPH | LFLMTYEHLK | PQKPSQRYVP | RVFGFKLH-- | KP | 288 |
| ANNOT-1486236-SEQ-ID-NO-366 | | | | | LP | 287 |
| CLONE-535483-SEQ-ID-NO-377 | GAYFGTTFPH | LFLMTYGQLK | PQKPAQGYVP | RVFGFKVH-- | KP | 261 |

Figure 9

| | | | | |
|---|---|---|---|---|
| GI-41052591-SEQ-ID-NO-397 | ---MSNPSSP | ATSTAAGEQD | LHDQDHRDEA | ALQQEHAAAG | IIPDDEDKLS | 47 |
| CLONE-32842-SEQ-ID-NO-384 | MEALFCSEIP | NNNIRSSIND | LSSSSSYTWP | MIMTSSSSSS | SSPTIMNIEN | 50 |
| GI-79518327-SEQ-ID-NO-399 | ---MNTLRP | ---HK----- | ---QQE---- | QAQQQEEAA- | ---------- | 20 |
| ANNOT-1468856-SEQ-ID-NO-394 | MKNLSTKFHR | HSPHHTDESE | NHEKEATEEE | QEQQQEEKA- | ---------- | 38 |
| CLONE-1919410-SEQ-ID-NO-396 | MNDFSSGFHP | PAF------- | -VPGHETKL | SAEEKQPAA- | ---------- | 29 |

| | | | | | | |
|---|---|---|---|---|---|---|
| GI-41052591-SEQ-ID-NO-397 | PPRCEWEFRL | AATVPS---- | -PALAGASDS | GSLDFDPTG | RHLATGGIAR | 92 |
| CLONE-32842-SEQ-ID-NO-384 | IPRCDWDLSL | SAVVSS---- | -ASTGSDA- | GAIEFDPTG | ETIATGGIAR | 93 |
| GI-79518327-SEQ-ID-NO-399 | RVEWDLSL | SIVVSS---- | -SSSSASDV | GAIEFDPTD | NIVATAGISR | 62 |
| ANNOT-1468856-SEQ-ID-NO-394 | RCEWDFSL | TTIVSSGNNN | ISSTPAISDA | LGVMEFDDTN | SIIATGGIAR | 86 |
| CLONE-1919410-SEQ-ID-NO-396 | RCEWDFSL | ATVVSS---- | -TANATVSDT | LGVMEFDPSN | TILATGGISLR | 72 |

| | | | | | | |
|---|---|---|---|---|---|---|
| GI-41052591-SEQ-ID-NO-397 | KIRIYRVAEP | SSPAA----- | ---------- | CI-------- | CVPAKLSSVR | 119 |
| CLONE-32842-SEQ-ID-NO-384 | KIRSYRLSSL | LESRD----- | ---------- | DHVTASESCI | CTPAKLSSLK | 128 |
| GI-79518327-SEQ-ID-NO-399 | KIREYGLPSL | LRNTAV---- | ---SGTGVSFV | DDATACEYT | CTPAKLSSLR | 106 |
| ANNOT-1468856-SEQ-ID-NO-394 | KIRIYNFKSL | FAHENT---- | -SQNAHE-TCL | DHARACDYV | CTPAKLSSIR | 132 |
| CLONE-1919410-SEQ-ID-NO-396 | KIRIYTENSL | ERPQEETVHS | QGKHQSLAFL | DHTNACDNEV | FTPAKLSSLR | 122 |

| | | | | | | |
|---|---|---|---|---|---|---|
| GI-41052591-SEQ-ID-NO-397 | MRPGGQEAMA | ASHVGCGDYD | GVVTEYDVER | GVPVWERDEH | EGRRVWALDY | 169 |
| CLONE-32842-SEQ-ID-NO-384 | MRPDFSGRV | GSGDYD | GVVTEYDVEK | QVPVYSERDEH | GGRRIWSVDY | 174 |
| GI-79518327-SEQ-ID-NO-399 | MRPGSGGRV | GSGDYD | GVMEYDLEK | RTPVFERDEH | GGRVWSVDY | 152 |
| ANNOT-1468856-SEQ-ID-NO-394 | MKPESDCRV | GSGDYD | GVMEYQLER | RTPIFERDEH | GGRSVWSVDY | 178 |
| CLONE-1919410-SEQ-ID-NO-396 | MKPGTGGRI | GSGDYD | GVVMEYDIET | KLPIFERDEH | GGRRVWSVDY | 168 |

| | | | | | | |
|---|---|---|---|---|---|---|
| GI-41052591-SEQ-ID-NO-397 | ARGGGAATMV | ASGSDDRITAH | VWDPRAPAGA | A-------- | RAGGAVLCVE | 216 |
| CLONE-32842-SEQ-ID-NO-384 | TLYNGSLLG | ASGSDDDGTVQ | MWDPR---NGG | TLEETVRPL | --GGAAICEVE | 219 |
| GI-79518327-SEQ-ID-NO-399 | TRHGGASTVG | ASGSDDDGTMQ | VWDPRCPPEE | SVGVRPAG | ICRSAVCCVE | 201 |
| ANNOT-1468856-SEQ-ID-NO-394 | SHWD--PVLG | ASGSDDDGTMQ | MWDTRCEISGE | G-VATVQP-G | VGRSAVCCVE | 224 |
| CLONE-1919410-SEQ-ID-NO-396 | SHSD--PFLG | ASGSDDDGTMQ | MWDPRCGEGG | GSVAKVQP-T | KSRSSVCCVE | 215 |

| | | | | | | |
|---|---|---|---|---|---|---|
| GI-41052591-SEQ-ID-NO-397 | FDPAGGPQ-A | VGADRRAAV | HDVRALGRGA | VASMDGHGRA | VTYVRWAATA | 266 |
| CLONE-32842-SEQ-ID-NO-384 | FDPFGGSIA | VGCADQNAYV | YDIRRLV-DP | LIVLDGHTKQ | VTYARFMDSH | 268 |
| GI-79518327-SEQ-ID-NO-399 | FDPSGGPAVA | VGCADRKGVY | YDIRKLV-DP | ALTLQHTKT | VSYVRFLDSG | 250 |
| ANNOT-1468856-SEQ-ID-NO-394 | FNPFGGPIVA | VGCADRRVG | YDIRMTG-DP | VFVLDGHRKT | VTYIKFLDNV | 273 |
| CLONE-1919410-SEQ-ID-NO-396 | FNPFGDALA | AGCADKKAYV | MDVRKMV-EP | VMLFDGHTKT | ITYVRFLNAQ | 264 |

Figure 9 - continued

| | | | | | | | |
|---|---|---|---|---|---|---|---|
| GI-41052591-SEQ-ID-NO-397 | RRVVTSAADG | THRLWALPAP | AAAETAAREV | RSYSGHVSGR | SFVGMGVWRG | | 316 |
| CLONE-32842-SEQ-ID-NO-384 | TIVTESTDG | SLKQWDI--- | ---DNGRRVV | RTYRGHVNNR | NFVGLSVWRH | | 311 |
| GI-79518327-SEQ-ID-NO-399 | TVVTAGIDG | CLKLWSV--- | ---EDG-RVI | RTYEGHVNSR | NFVGLSVWRN | | 292 |
| ANNOT-1468856-SEQ-ID-NO-394 | TLVSASTDG | CLKLWDS--- | ---DNS-NVI | RSYKGHVNSR | SFIGLSVWRN | | 315 |
| CLONE-1919410-SEQ-ID-NO-396 | TLVSAGTDG | CLKLWNI--- | ---VDS-RLL | RTYKGHVNSR | SFVGLSVWRH | | 306 |

| | | | | | | | |
|---|---|---|---|---|---|---|---|
| GI-41052591-SEQ-ID-NO-397 | AGLTASGSES | GHVFVYDLRW | SKPIWVHPFS | HA-------- | -DAFVSAVAR | | 357 |
| CLONE-32842-SEQ-ID-NO-384 | GGLVSGCSEN | NQVFVYDKRW | EEPVWCGLG | HTNR-FGSD- | -RRFVSSVCL | | 358 |
| GI-79518327-SEQ-ID-NO-399 | GALFCCGSEN | NRVFVYDRRW | GKPVWVDGFE | PVGMNSGSD- | -KRFVSSVCW | | 340 |
| ANNOT-1468856-SEQ-ID-NO-394 | GGLLGCGSEN | NKVFVYDRRW | GEPIWVHESN | PVGR-DGCG- | -GGFVSSVCW | | 362 |
| CLONE-1919410-SEQ-ID-NO-396 | GGLLGCGSEN | NQVFVYDTRW | GEPIWVHGFE | PVGR-DSSDH | QHAFVSSVCW | | 355 |

| | | | | | | |
|---|---|---|---|---|---|---|
| GI-41052591-SEQ-ID-NO-397 | RQLAGDDSDG | QLVAGGSDGV | KLFITHRRL | TPDVAGVGGD | DDDDVAA | 404 |
| CLONE-32842-SEQ-ID-NO-384 | RQVDEDMC- | TLVAGGSDGA | LEIFSGKQS- | ---------- | ------- | 385 |
| GI-79518327-SEQ-ID-NO-399 | RQSGVDQC- | RQVEEDQC- | LVAGGSDGV | LQVYVGKRKP | ---------- | ------- | 368 |
| ANNOT-1468856-SEQ-ID-NO-394 | RQVEEDQC- | TLVAGGSDGD | QVFQGRRKS | ---------- | ------- | 390 |
| CLONE-1919410-SEQ-ID-NO-396 | RQVNEDQC- | TLVAGGSNGV | LRVFVGKRKS | DSE------- | ------- | 386 |

*Figure 10*

| | | | | | | |
|---|---|---|---|---|---|---|
| CLONE-251923-SEQ-ID-NO-401 | MPAGHGVRAR | RDLFARPFR | KKGYIPLSTY | LRTFKVGDYV | DVKVNGAIHK | 50 |
| CLONE-1445194-SEQ-ID-NO-433 | MPAGHGVRAR | RDLFARPFR | KKGYIPLSTY | LRTFKVGDYV | DVKVNGAIHK | 50 |
| CLONE-1316006-SEQ-ID-NO-431 | MPAGHGLRSR | RDLFARPFR | KKGYIPLTTY | LRTYKVGEHV | DVKVNGAVHK | 50 |
| CLONE-511820-SEQ-ID-NO-429 | MPAGHGLRSR | RDLFARPFR | KKGYIPLTTY | LRTYKIGDYV | DVKVNGAVHK | 50 |
| ANNOT-1475022-SEQ-ID-NO-427 | MPAGHGLRAR | RDLFARPFR | KKGYIPLTTY | LRTYKIGDHV | DVKVNGAVHK | 50 |
| GI-31432571-SEQ-ID-NO-434 | MPAGHGLRAR | RDLFARPFR | KKGYIPLTTY | LRTYKIGEHV | DVKVNGAVHK | 50 |

| | | | | | | |
|---|---|---|---|---|---|---|
| CLONE-251923-SEQ-ID-NO-401 | GIPHKFYHGR | TGRIWNVTKR | AVGVEVNKQI | GNRIRKRIH | VRVEHVQQSR | 100 |
| CLONE-1445194-SEQ-ID-NO-433 | GMPHKFYHGR | GRVWNVTKR | AVGVEVNKQI | GNRIRKRLH | VRVEHVQQSR | 100 |
| CLONE-1316006-SEQ-ID-NO-431 | GMPHKFYHGR | GRVWNVTKR | AIGVEVNKQV | GNRIKKRIH | VRVEHVQPSR | 100 |
| CLONE-511820-SEQ-ID-NO-429 | GMPHKFYHGR | GRVWNVTKR | AIGVEINKQV | NGRIRKRIH | VRVEHVQPSR | 100 |
| ANNOT-1475022-SEQ-ID-NO-427 | GMPHKFYHGR | GRVWNVTKR | AIGVEINKQV | GNRIRKRIH | VRVEHLPSR | 100 |
| GI-31432571-SEQ-ID-NO-434 | GMPHKFYHGR | GRVWNVTKR | AIGVEINKQV | GNRIRKRIH | VRVEHVQPSR | 100 |

| | | | | | | |
|---|---|---|---|---|---|---|
| CLONE-251923-SEQ-ID-NO-401 | CAEEFKLRKK | QNDVLKADAK | ARGEISTKR | QPKGPKPGFM | VEGMLETVT | 150 |
| CLONE-1445194-SEQ-ID-NO-433 | CAEEFKLRKK | KNDELKAAAK | ARGEISTKR | QPKGPKPGFM | VEGMLETVT | 150 |
| CLONE-1316006-SEQ-ID-NO-431 | CNEEFLQRKL | NNDKLKAEAK | ARGEVSTKR | QPAGPKPGFM | VEGTILETVT | 150 |
| CLONE-511820-SEQ-ID-NO-429 | CTEEFRLRKV | KNDQLKADAK | ERGEVSTKR | QPLGPKPGFM | VEGTILETVT | 150 |
| ANNOT-1475022-SEQ-ID-NO-427 | CTEEFRLRKK | KNDQLKAEAK | ARGEVSTKR | QPEGPKPGFM | VEGALETVT | 150 |
| GI-31432571-SEQ-ID-NO-434 | CTEEFRLRKK | KNDQLKADAK | ARGEVSKR | QPQGPKPGFM | VEGALETVT | 150 |

| | | |
|---|---|---|
| CLONE-251923-SEQ-ID-NO-401 | PIPYDVVNDL | KGGY | 164 |
| CLONE-1445194-SEQ-ID-NO-433 | PIPYDVVNDL | KGGY | 164 |
| CLONE-1316006-SEQ-ID-NO-431 | PIPYDVVNDL | KGGY | 164 |
| CLONE-511820-SEQ-ID-NO-429 | PIPYDVVNDL | KGGY | 164 |
| ANNOT-1475022-SEQ-ID-NO-427 | PIPYDVVNDL | KGGY | 164 |
| GI-31432571-SEQ-ID-NO-434 | PIPYDVVNDL | KGGY | 164 |

Figure 11

| Clone | | | | | | |
|---|---|---|---|---|---|---|
| CLONE-751992-SEQ-ID-NO-609 | ---------- | ---------- | MAAPSGGGGG | ---------- | ---------- | 3 |
| CLONE-367249-SEQ-ID-NO-445 | ---------- | ---------- | MAAPSGGGGG | GAGEGSSS-- | AAA------- | 38 |
| CLONE-1579587-SEQ-ID-NO-447 | ---------- | ---------- | MAAGAGAGGG | GAGEGSSS-- | AAA------- | 38 |
| GI-77554746-SEQ-ID-NO-448 | ---------- | ---------- | MRTPMSDTQ- | G-GEDSNGG | GTSPGGVSAA | 48 |
| CLONE-149496-SEQ-ID-NO-436 | ---------- | ---------- | ---------- | ---------- | ---HVQ---- | 29 |
| ANNOT-1525459-SEQ-ID-NO-443 | ---------- | ---------- | MPDHNNR--- | ---------- | ----QVK---- | 27 |

| | | | | | | |
|---|---|---|---|---|---|---|
| CLONE-751992-SEQ-ID-NO-609 | ---------- | ---------- | QMANSS---- | ---------- | AMT GAH---- | MWQ | 
| CLONE-367249-SEQ-ID-NO-445 | ---------- | ---------- | QMNL------ | ---------- | AMT GAH---G | VDQVTEAMW | 38 |
| CLONE-1579587-SEQ-ID-NO-447 | ---------- | ---------- | QMNL------ | ---------- | AMT GAH---G | VDQVTEAMW | 38 |
| GI-77554746-SEQ-ID-NO-448 | ---------- | ---------- | QMTLGG---- | ---------- | APAI GPHHLG | VAAAEAMW | 48 |
| CLONE-149496-SEQ-ID-NO-436 | ---------- | ---------- | KMKVNE---- | ---------- | SSLVSIR--S | SDKTEDAFR | 29 |
| ANNOT-1525459-SEQ-ID-NO-443 | ---------- | ---------- | RLKI HDHQEQ | ---------- | SNAVSNO--S | AENI EEATW | 27 |

| | | | | | | |
|---|---|---|---|---|---|---|
| CLONE-751992-SEQ-ID-NO-609 | RNTAT ASARM | GATMQSGPYP | VRPGEPDCTY | YLRT GLCRFG | MSCRFNHPQD | 49 |
| CLONE-367249-SEQ-ID-NO-445 | RKLAVAAARM | CDAMELGPYP | ERVCDPDCSY | YMRT GMCRFG | MT CKFNHPAD | 82 |
| CLONE-1579587-SEQ-ID-NO-447 | RKLAVAAARM | CDAMELGPYP | ERVCDPDCSY | YMRT GMCRFG | MT CKFNHPAD | 82 |
| GI-77554746-SEQ-ID-NO-448 | RKLAVAAARM | GESMESTPYP | ERI GEPDCSY | YMRT GLCRFG | MT CKFNHPPN | 94 |
| CLONE-149496-SEQ-ID-NO-436 | HLPQDVIAYY | IGVEELNPYP | DRPGERDCQF | YLRT GLCGYG | SCRYNHPT-- | 74 |
| ANNOT-1525459-SEQ-ID-NO-443 | YAALGAQL-- | GGMAQSSPYP | DRPGAPDCGY | YLRT GLCGYG | SNCRFNHPV-- | 76 |

| | | | | | | |
|---|---|---|---|---|---|---|
| CLONE-751992-SEQ-ID-NO-609 | KGEYPERVGQ | PECQYLKTG | TCKFGPTCKF | HHPREKAGI A | | 99 |
| CLONE-367249-SEQ-ID-NO-445 | KGEYPQRI GQ | PECQYYLKTG | TCKFGATCKF | HHPREKAAMA | | 132 |
| CLONE-1579587-SEQ-ID-NO-447 | KGEYPQRI GQ | PECQYYLKTG | TCKFGATCKF | HHPREKAAMA | | 132 |
| GI-77554746-SEQ-ID-NO-448 | NGEYPYRVGQ | PECQYYLKTG | TCKFGATCKF | HHPREKAALA | | 144 |
| CLONE-149496-SEQ-ID-NO-436 | REELPERI GQ | PDCEYFLKTG | ACKYGPTCKY | HHPKDRNG-A | | 122 |
| ANNOT-1525459-SEQ-ID-NO-443 | REELPERVGQ | PDCGYYLKTG | TCKYGSTCKY | HHPRDRNG-A | | 123 |

| | | | | | | |
|---|---|---|---|---|---|---|
| CLONE-751992-SEQ-ID-NO-609 | GMVQLNTLGY | PLRPNERECA | YYLKTGQCKY | GNTCKFNHPE | IFN---AVASS | 147 |
| CLONE-367249-SEQ-ID-NO-445 | TRVQLNELGY | PLRLNEKECA | YYLRTGQCKF | GSTCKFHHPQ | PST---MMVAV | 180 |
| CLONE-1579587-SEQ-ID-NO-447 | TRVQLNELGY | PLRLNEKECA | YYLRTGQCKF | GSTCKFHHPQ | PST---MMVAV | 180 |
| GI-77554746-SEQ-ID-NO-448 | NRVQLNVLGY | PMRPNEKECA | YYLRTGQCKF | ASTCKFHHPQ | PSN---TMVAV | 192 |
| CLONE-149496-SEQ-ID-NO-436 | QPVMFNVI GL | PMRLGEKPCP | YYLRTGTCRF | CVACKFHHPQ | PDN------- | 165 |
| ANNOT-1525459-SEQ-ID-NO-443 | GPVSFNALGL | PMRQDEKSCP | YYMRTRSCKF | GVACKFHHPQ | PASLGTSFSL | 173 |

| | | | | | | |
|---|---|---|---|---|---|---|
| CLONE-751992-SEQ-ID-NO-609 | RGSP YPPVH | NSCSTGPH-S | YT GLMASWTY | PRL GSFI PSP | RWQSPSNYLP | 195 |
| CLONE-367249-SEQ-ID-NO-445 | RGS--VYSPGQ | SATSPGHH-A | YQGAVT SWPL | SRSASFI ASP | RWPGHSSYAQ | 228 |
| CLONE-1579587-SEQ-ID-NO-447 | RGS--VYSPGQ | SATSPGHH-A | YQGAVT SWPL | SRSASFI ASP | RWPGHSSYAQ | 228 |
| GI-77554746-SEQ-ID-NO-448 | RWS--MYSPGQ | SATSPGQH-T | YPGAVT NWTL | SRSASFI ASP | RWPGHSGMAQ | 240 |
| CLONE-149496-SEQ-ID-NO-436 | GHSTAYG--- | MSSFFAADLR | YASGLTMM-- | ---STYGTLP | RPQVPQSYMP | 207 |
| ANNOT-1525459-SEQ-ID-NO-443 | TEAAEGSTG | SPI VPSSGLP | VVGGLPI WSL | PR--APLMSGT | NLDGPQAYMP | 222 |

Figure 11 - continued

A sequence alignment figure showing protein sequences for multiple clones. Due to the complexity and density of the aligned sequence data, the content is presented as-is:

```
                                                                              242
                                                                              275
                                                                              275
                                                                              286
                                                                              238
                                                                              241

CLONE-751992-SEQ-ID-NO-609    MIVPQ--GLV  QVPNWNSYPG  QMPVSSPPES  RLQSPGAQQY  YT-GTSRQGEA
CLONE-367249-SEQ-ID-NO-445    VIVPP--GLV  QVPGWSPYAA  QIGS-SSSDD  QQRTPGAAQY  YT GSROSGTP
CLONE-1579587-SEQ-ID-NO-447   VIVPP--GLV  QVPGWSPYAA  QIGS-SSSDD  QQRTPGAAQY  YT GSROSGTP
GI-77554746-SEQ-ID-NO-448     VIVPQ--GLV  QVPGWNPYAA  QMGS-SSPDD  QQRTPVTTQY  Y--GSRQSETG
CLONE-149496-SEQ-ID-NO-436    LVSPSQGFL-  PPQGWAPYMA  ASNSMYNVKN  Q--------   ---------
ANNOT-1525459-SEQ-ID-NO-443   VVVSPSPGIT  PVPGWNTY--  ---------   ---------   ---------

292
                                                                              325
                                                                              325
                                                                              336
                                                                              279
                                                                              267

CLONE-751992-SEQ-ID-NO-609    XAGNQGMQSX  YRSSSFPAPQ  YALQRENVFP  ERPDQPECLT  YTKTGDCKFG
CLONE-367249-SEQ-ID-NO-445    GIGDRGMFSS  YQAGSVPVGL  YAVQTENVFP  ERPDQPECQF  YMKTGDCKFG
CLONE-1579587-SEQ-ID-NO-447   GIGDRGMFSS  YQAGSVPVGL  YAVQTENVFP  ERPDQPECQF  YMCKFGDCKFG
GI-77554746-SEQ-ID-NO-448     GMGDHGMYQS  YQGSVPVGV   YTVQGENIFP  ERPDQPECQF  YMKTGDCKFG
CLONE-149496-SEQ-ID-NO-436    -----P---   MYTSGSFASMA MAVALNRGIS  ESSDQPECRF  FMNIGTCKYG
ANNOT-1525459-SEQ-ID-NO-443   ---------   ---------   --SPLLP     ERPCQPECRH  FMSIGTCKYG 342
                                                                              375
                                                                              375
                                                                              386
                                                                              329
                                                                              317

CLONE-751992-SEQ-ID-NO-609    AVKKFHHPPV  RSQPPPDCLT  SPMGLPLRPG  EELCKFYSRY  GICKFGVNCK
CLONE-367249-SEQ-ID-NO-445    SVCKFHHPRE  RITPTPNCAL  SPLGLPLRPG  EPICSFYNRY  GMCKFGPNCK
CLONE-1579587-SEQ-ID-NO-447   SVCKFHHPRE  RIIPTPNCAL  SPLGLPLRPG  EPICSFYNRY  GMCKFGPNCK
GI-77554746-SEQ-ID-NO-448     AVCKFHHPKE  RLVPAPNCAL  NSLGLPLRPG  EPVCTFYSRY  GICKFGPNCK
CLONE-149496-SEQ-ID-NO-436    DDCKYSHPGV  RISQPPSLT   NPLTLPARPG  QPIACGNFRSY GECKFGPNCK
ANNOT-1525459-SEQ-ID-NO-443   SDCKYHHPKE  RIAQLATNTM  GLLGLPSRPG  --ITYPRMAQAAPV  GICKFGPITCR 375
                                                                              405
                                                                              405
                                                                              416
                                                                              363
                                                                              364

CLONE-751992-SEQ-ID-NO-609    DHPM-----   ---------   --AAPMGVTA  YGYSASASPN  APMGSASPGM
CLONE-367249-SEQ-ID-NO-445    FHHPM----   ---------   -GNPM--YG   HASSPTSEAQ  TSRRMLAH-V
CLONE-1579587-SEQ-ID-NO-447   FHHPM----   ---------   -GNPM--YG   HASSPTSEAQ  TSRRMLAH-V
GI-77554746-SEQ-ID-NO-448     AVDHPM---   ---------   --GTLM--YG  SATSPRGDVS  SMHYQLSPLS
CLONE-149496-SEQ-ID-NO-436    FDHPMLPYP-  ---------   --GLTM--    SLPLPFASPV  THQRISPI-
ANNOT-1525459-SEQ-ID-NO-443   VDHPLHTYPY  NYSLSLPSLS  IMDSPL--IT  YPRMAQAAPV  LSKLPDL- 401
                                                                              443
                                                                              443
                                                                              454
                                                                              404
                                                                              409

CLONE-751992-SEQ-ID-NO-609    PLRVCVRLLR  QGSLAFDPTL  DLDDV----   VERITEREAS  ---------
CLONE-367249-SEQ-ID-NO-445    PSHPEV--SP  DSGSGRSRRI  VHSDSQQIPS  VERITEREAS  ---------
CLONE-1579587-SEQ-ID-NO-447   PSHPEV--SP  DSGSGRSRRI  VHSDSQQIPS  VERITEREAS  ---------
GI-77554746-SEQ-ID-NO-448     PGHPGL---L  DGGSGRSHRV  PQSDSQQIPS  GDGNAFREAS  ---------
CLONE-149496-SEQ-ID-NO-436    PNRSDSKSLS  NGKPDVKKES  SETEKPDNGE  VQPLSEDASS  P--------
ANNOT-1525459-SEQ-ID-NO-443   HNPDGASYNK  HQNPDTSTKI  SDDPTLEQAGS PPPHSSQASS  EPSHD
```

| | | | | | | |
|---|---|---|---|---|---|---|
| GI-6016226-SEQ-ID-NO-462    | TGVAPGEGT | GATMSDDDDD | QADSDINFLD | GGFDGPDSMG | FGPLVPTESE | 317 |
| GI-1805618-SEQ-ID-NO-461    | TGASPGEGT  | GATMSDGEDD | QADSEANMYD | PSLDGADNMG | FG--PTESE  | 260 |
| CLONE-515966-SEQ-ID-NO-460  | TGVSPCEGT  | GATMSDDEDD | QAESNANLYE | GSLDGGETLG | FGPLVPTESE | 226 |
| ANNOT-1531214-SEQ-ID-NO-458 | TGVSPGEGT  | GATMSDDDED | QVDSDANLFV | GSLEGADTLG | FGPLVPTESE | 307 |
| CLONE-21240-SEQ-ID-NO-450   | TGVSPGEGM  | GATMSDDEDE | QVESDANMFD | G----GLDVLG | FGPLIPTESE | 312 |

| | | | | | | |
|---|---|---|---|---|---|---|
| GI-6016226-SEQ-ID-NO-462    | RSLMERVRQE | KHELKQGYK- | EKIVDIREEI | RKRRAGKLP | GDTTSVLKAW | 367 |
| GI-1805618-SEQ-ID-NO-461    | RSLMERVRQE | KHELKQGYK- | EKLIDIREEI | RKRRAGKLP | GDTTSVLKAW | 310 |
| CLONE-515966-SEQ-ID-NO-460  | RSLMERVRHE | KHELKQGYK- | EKIVDIREEI | RKRRAGKLP | GDTTSLLKAW | 276 |
| ANNOT-1531214-SEQ-ID-NO-458 | RSLMERVRQE | KHELKQGYK- | EKIVDIREEI | RKRRAGKLP | GDTTSVLKAW | 357 |
| CLONE-21240-SEQ-ID-NO-450   | RSLMERVRQE | KHELKQGYK- | EKIVDIREEI | RKRRAGKLP | GDTTSVLKAW | 362 |

| | | | | | | |
|---|---|---|---|---|---|---|
| GI-6016226-SEQ-ID-NO-462    | WQSHSKWPYP | TEEDKARLVQ | ETGLQLKQIN | NWFINQRKRN | WHS-NPSTSS | 416 |
| GI-1805618-SEQ-ID-NO-461    | WQSHAKWPYP | TEEDKARLVQ | ETGLQLKQIN | NWFINQRKRN | WHS-NPSSST | 359 |
| CLONE-515966-SEQ-ID-NO-460  | WQSHSKWPYP | TEEDKARLVQ | ETGLQLKQIN | NWFINQRKRN | WHTNNPSSSS | 326 |
| ANNOT-1531214-SEQ-ID-NO-458 | WQSHSKWPYP | TEEDKARLVQ | ETGLQLKQIN | NWFINQRKRN | WHS-NPSTST | 406 |
| CLONE-21240-SEQ-ID-NO-450   | WQSHSKWPYP | TEEDKARLVQ | ETGLQLKQIN | NWFINQRKRN | WHS-NPSSSI | 411 |

| | | | | | | |
|---|---|---|---|---|---|---|
| GI-6016226-SEQ-ID-NO-462    | SDKSQTQECR  | ---------- | ---------- | ---------- | ---------- | 426 |
| GI-1805618-SEQ-ID-NO-461    | SVKTKRKSNA  | GDNNS----- | ---------- | ---------- | ---------- | 374 |
| CLONE-515966-SEQ-ID-NO-460  | NSKSKRKSSA  | GEASNQSFM- | ---------- | ---------- | ---------- | 345 |
| ANNOT-1531214-SEQ-ID-NO-458 | VLKSKRKRKT  | LLSLGKEKQT | LSINAEVEAT | SPLEEGWYAG | VTDSSH     | 452 |
| CLONE-21240-SEQ-ID-NO-450   | VLKNKRKSNA  | GDNSGRERFA | ---------- | ---------- | ---------- | 431 |

Figure 13

| | | | | | | | |
|---|---|---|---|---|---|---|---|
| GI-51979356-SEQ-ID-NO-470 | MDEFQSIP | | | CLAG | | AAAD RRAQA | QQGPASRCG— 37 |
| GI-67523403-SEQ-ID-NO-471 | MDFQSIP | | | CLAG | | AAAD RRV | QGPASRCGV 35 |
| CLONE-1640653-SEQ-ID-NO-469 | MQEIHSI | | | REFG | | GGGD RRLRP | THQ 26 |
| ANNOT-1473196-SEQ-ID-NO-467 | MQDIHSI | | | RLFS GC | | GGGD RRLRP | HH 29 |
| CLONE-19080-SEQ-ID-NO-464 | MQDIHDFSMN | GVGGGGGGG | | RFF GGGI GGG | | GGGD RRMRA | HQNNI L 45 |

| | | | | | | | |
|---|---|---|---|---|---|---|---|
| GI-51979356-SEQ-ID-NO-470 | FSQAASAQPE | AVKCPRCES | TNTKFCYYNN | YNLSQPRHFC | KSCRRYWTKG | 82 |
| GI-67523403-SEQ-ID-NO-471 | NHHQQ | AAVKCPRCES | TNTKFCYYNN | YNLSQPRHFC | KSCRRYWTKG | 85 |
| CLONE-1640653-SEQ-ID-NO-469 | | PP KCPRCDS | NTKFCYYNN | YNLSQPRHFC | KNCRRYWTKG | 71 |
| ANNOT-1473196-SEQ-ID-NO-467 | QNHQ | ALKCPRCDS | NTKFCYYNN | YNLSQPRHFC | KSCRRYWTKG | 72 |
| CLONE-19080-SEQ-ID-NO-464 | NHHQ | SLKCPRCNS | NTKFCYYNN | YNLSQPRHFC | KNCRRYWTKG | 88 |

| | | | | | | |
|---|---|---|---|---|---|---|
| GI-51979356-SEQ-ID-NO-470 | GVLRNVPVGG | GCRKTKRS | | | GSSAASS | 108 |
| GI-67523403-SEQ-ID-NO-471 | GVLRNVPVGG | GCRKAKRS | | | SSSAS | 108 |
| CLONE-1640653-SEQ-ID-NO-469 | GVLRNVPVGG | GCRKSKRSNK | PKTTTSAAAT | TSSNNNNNP | SSSETAAAT | 121 |
| ANNOT-1473196-SEQ-ID-NO-467 | GVLRNVPVGG | GCRKTKRS | | KLKQNT | PSTTSDATT | 106 |
| CLONE-19080-SEQ-ID-NO-464 | GVLRNVPVGG | GCRKAKRS | | | KLKQVPSSS | 115 |

| | | | | | | |
|---|---|---|---|---|---|---|
| GI-51979356-SEQ-ID-NO-470 | APSTPTAATD | NAKNQRRASA | SSPRSSGGS | GNTSPTAAAA | TTPTTPATPS | 158 |
| GI-67523403-SEQ-ID-NO-471 | APSTPAATDA | KSQRRASA | SSSSRSNSGS | GSASPTAAAE | ETTTTETEPP | 156 |
| CLONE-1640653-SEQ-ID-NO-469 | APTPPQQPPP | PLELEH | NSHSHSSES | STYT | VAATEAMSA | 160 |
| ANNOT-1473196-SEQ-ID-NO-467 | STRPQELQE | QHQRRDHM | SSNSHSSES | SSLTATNTN | ANTAVEAVSA | 154 |
| CLONE-19080-SEQ-ID-NO-464 | SADKPTTTQD | DHHVEEKS | STSHSSSES | SSLTASN | STTVAAVSV | 159 |

| | | | | | | |
|---|---|---|---|---|---|---|
| GI-51979356-SEQ-ID-NO-470 | SNTIAVINHA | TTTTTN | PFPTDVP | PPAPI FADQA | AALASLFAPP | 203 |
| GI-67523403-SEQ-ID-NO-471 | PPPTPSSNSN | SNAVSFANRM | TNYPFAADVP | PLAPI FADQA | AALASLFAPP | 206 |
| CLONE-1640653-SEQ-ID-NO-469 | PTTNAVSNSN | LLDNNRE-S | KMFANP | NPYLEQS | RSG-CLFSDI | 201 |
| ANNOT-1473196-SEQ-ID-NO-467 | LSVNSVSNNL | LNGIVESK | FPRGDMNP | SFEPALLEQG | SDC-GIFSEI | 200 |
| CLONE-19080-SEQ-ID-NO-464 | TAAAEVASSV | PGFDMPN-M | KLYGNGIEW | STLLGG | SSAGGVFSEI | 204 |

| | | | | | | |
|---|---|---|---|---|---|---|
| GI-51979356-SEQ-ID-NO-470 | PPPPLPV | FSFAA | | | | 215 |
| GI-67523403-SEQ-ID-NO-471 | PPPPLPV | FSFSA | | | | 218 |
| CLONE-1640653-SEQ-ID-NO-469 | ESFSSLVNLN | NQALGFGFEN | NNSNI SI LDA | TSFRFGVSVT | NPHGNDQVLA | 251 |
| ANNOT-1473196-SEQ-ID-NO-467 | GSFTSLI-TS | TNDLSFGFSN | TTNQ | | QQQGLE | 230 |
| CLONE-19080-SEQ-ID-NO-464 | GGFPAVSAI E | TTP- GFGG | KFVN | | | 226 |

Figure 13 - continued

```
GI-51979356-SEQ-ID-NO-470    ----------    ----------    ----------    QARTEDGI    ASVLLAGQTT    APTAATVA--    ------DMTPF    246
GI-67523403-SEQ-ID-NO-471    ----------    ----------    ----------    EPKMEEAI    GSLLLPGQEA    SQEPEEPICT    STVA-DMAPF    255
CLONE-1640653-SEQ-ID-NO-469  APGGCHGQWQ    QQQQNHHEFG    TASFLDHTVP    GGGEIDQTIH    LEFSSIQHKA    G---------    ------HQGGF    297
ANNOT-1473196-SEQ-ID-NO-467  HHVQNNQNQQ    QWQNQHQEMT    ----------    GETVQQQQFG    AELSALPSSI    DRTAQVEFQG    RSTENTGGGF    280
CLONE-19080-SEQ-ID-NO-464    ----------    QDDHIKLE      ----------    ----------    ----------    ----------    RSSD-PNMGF    263

GI-51979356-SEQ-ID-NO-470    TSLDAG----    -FELG-----    DVPPAAYWNA    GSCWTDVPDP    ------NVYLP    282
GI-67523403-SEQ-ID-NO-471    MSLDAG----    -FELG-----    DASPADYWNG    GSCWTDVQDP    ------SVYLP    291
CLONE-1640653-SEQ-ID-NO-469  GPLDWQPG-G    DQG-------    NTVDQPYWTH    HTHWSDQDNP    SSLFHLP       341
ANNOT-1473196-SEQ-ID-NO-467  GALDWQLGSG    DQAGGFYL-P    NTVDQAYWSQ    SQWNDM        TAYLP         321
CLONE-19080-SEQ-ID-NO-464    EPLDWGSGG-    DQT-LFDLI     STVDHAYWSQ    SQWTSSDQD     QSGLYLP       307
```

Figure 14

| | | | | | | |
|---|---|---|---|---|---|---|
| GI-34901270-SEQ-ID-NO-553 | MGKDEVMESG | GAAGEFAAKD | TIDPPPAPL | DAAELCSWSL | YRAVIAEFIA | 50 |
| GI-68533200-SEQ-ID-NO-554 | MAKD----EAA | PPGGEYAAKD | YSDPPPAPLF | DAEELTKWSL | YRALIAEFIA | 48 |
| ANNOT-1515353-SEQ-ID-NO-501 | MAKD----E-V | AEHGETVIKD | YQDPPPAPLF | DAEELGQWSF | YRAVIAEFIA | 46 |
| CLONE-1095849-SEQ-ID-NO-505 | MAKD----VE-G | AEG----FAARD | YEDPPPTPFF | DAEELTKWSL | YRAVIAEFVA | 45 |
| CLONE-1390684-SEQ-ID-NO-507 | MAKD----VE-G | AEG----FAARD | YEDPPPTPFF | DAEELTKWSL | YRAVIAEFVA | 45 |
| CLONE-1411718-SEQ-ID-NO-550 | MAKD----LE-G | AEG----FAARD | YEDPPPAPFF | DAEELTKWSL | YRAVIAEFVA | 45 |
| CLONE-33231-SEQ-ID-NO-473 | MAKD----LD-V | NESGPPAARD | YKDPPPAPFF | DWEELRKWP | YRAVIAEFVA | 47 |
| CLONE-1508487-SEQ-ID-NO-552 | MAKD----LE-V | ODGGATAARD | VDPPPAPL | DMEEFGKWSL | YRAVIAEFVA | 47 |
| | | | | | | |
| GI-34901270-SEQ-ID-NO-553 | TLLFLYTTVA | TVIGYKHQTD | ---ASASGAD | AACGGVGVLG | AWAFGGMIF | 97 |
| GI-68533200-SEQ-ID-NO-554 | TLLFLYITVA | TVIGYKHQAD | PAGPNAADAA | -CGGVGILG | AWAFGGMIF | 96 |
| ANNOT-1515353-SEQ-ID-NO-501 | TLLFLYYTVL | TVIGYKSQTD | ---PDKGLDA | CGGVGILG | AWAFGGMIF | 91 |
| CLONE-1095849-SEQ-ID-NO-505 | TLLFLYYTVL | TVIGYK--SSD | TKAGGDD | CGGVGILG | SWAFGGMIF | 90 |
| CLONE-1390684-SEQ-ID-NO-507 | TLLFLYYTVL | TVIGYK--SSD | TKAGGDE | CGGVGILG | SWAFGGMIF | 90 |
| CLONE-1411718-SEQ-ID-NO-550 | TLLFLYYTVL | TVIGYK--SSD | TKAGGDE | CGGVGILG | AWAFGGMIF | 90 |
| CLONE-33231-SEQ-ID-NO-473 | TLLFLYYTVL | TVIGYKHQTD | ATAGGVD | CGGVGILG | AWAFGGMIF | 92 |
| CLONE-1508487-SEQ-ID-NO-552 | TLLFLYVSVL | TVIGYKAQTD | SNAGGVD | CGGVGILG | AWAFGGMIF | 92 |
| | | | | | | |
| GI-34901270-SEQ-ID-NO-553 | LVYCTAGIS | GGHINPAVTF | GLFLARKVSL | VRAILYIVAQ | CLGAICGVGL | 147 |
| GI-68533200-SEQ-ID-NO-554 | VLVYCTAGVS | GGHINPAVTF | GLFLARKVSL | VRAVLYIIAQ | CLGAICGVGL | 146 |
| ANNOT-1515353-SEQ-ID-NO-501 | VLVYCTAGIS | GGHINPAVTF | GLFLARKVSL | RAVLYMVAQ | CLGAICGCGL | 141 |
| CLONE-1095849-SEQ-ID-NO-505 | LVYCTAGIS | GGHINPAVTF | GLFLARKVSL | VRAVLYMVAQ | CLGAICGVGF | 140 |
| CLONE-1390684-SEQ-ID-NO-507 | LVYCTAGIS | GGHINPAVTF | GLFLARKVSL | VRAVLYMVAQ | CLGAICGVGF | 140 |
| CLONE-1411718-SEQ-ID-NO-550 | LVYCTAGIS | GGHINPAVTF | GLFLARKVSL | VRAVLYMVAQ | CLGAICGVGF | 140 |
| CLONE-33231-SEQ-ID-NO-473 | VLVYCTAGIS | GGHINPAVTV | GLFLARKVSL | VRTVLYIVAQ | CLGAICGCGF | 142 |
| CLONE-1508487-SEQ-ID-NO-552 | VLVYCTAGVS | GGHINPAVTF | GLFLARKVSL | VRTVLYIVAQ | CLGAICGCGL | 142 |
| | | | | | | |
| GI-34901270-SEQ-ID-NO-553 | VKAFOSAYFN | RYGGGANELA | AGYSKGTGLA | AEIIGTFVLV | YTVFSATDPK | 197 |
| GI-68533200-SEQ-ID-NO-554 | VKQFOSAFYY | RYGGGANELQ | AGYSKGTGLA | AEIIGTFVLV | YTVFSATDPK | 196 |
| ANNOT-1515353-SEQ-ID-NO-501 | VKAFQRSYYN | HYGGGANELA | EGYNKGTGLA | AEIIGTFVLV | YTVFSATDPK | 191 |
| CLONE-1095849-SEQ-ID-NO-505 | VKAFQSAYYY | RYGGGANSLA | DGYSTGTGLA | AEIIGTFVLV | YTVFSATDPK | 190 |
| CLONE-1390684-SEQ-ID-NO-507 | VKAFQSSYYY | RYGGGANSLA | DGYSTCTGLA | AEIIGTFVLV | YTVFSATDPK | 190 |
| CLONE-1411718-SEQ-ID-NO-550 | VKAFQSSYYY | RYGGGANSLA | DGYSTGTGLA | AEIIGTFVLV | YTVFSATDPK | 190 |
| CLONE-33231-SEQ-ID-NO-473 | VKAFQSSYYT | RYGGGANELA | DGYNKGTGLG | AEIIGTFVLV | YTVFSATDPK | 192 |
| CLONE-1508487-SEQ-ID-NO-552 | VKAFQSSYYT | RYGGGANELA | DGYNKGTGLG | AEIIGTFVLV | YTVFSATDPK | 192 |

Sequence alignment of:
- CLONE-354406-SEQ-ID-NO-562
- GI-77555729-SEQ-ID-NO-563
- CLONE-33877-SEQ-ID-NO-556
- ANNOT-1442675-SEQ-ID-NO-560

(Multiple sequence alignment figure showing aligned protein sequences in blocks, with residue position numbers 50/45/43/30, 100/95/93/80, 150/145/143/130, 200/195/193/180, 250/245/242/229, 299/295/281/277, and 331/345/305/322 at the ends of successive alignment blocks.)

Figure 15 - continued

```
CLONE-354406:SEQ:ID:NO-562  -GHGMDHP  HPEKRNYRVP  ----------  ----------  -PNEAR----  354
GI-77555729:SEQ:ID:NO-563   DNGDHGSNKT  RSNQSGSRVP  FGANDGLHHD  KQSMTENKNL  PSHGNSSER-  395
CLONE-33877:SEQ:ID:NO-556   ----------  ----------  ----------  ----------  -------Y--  306
ANNOT-1442675:SEQ:ID:NO-560 QTIDSEASSV  VEDGDKNQP-  ----------  ----------  ----RTGDY  347

CLONE-354406:SEQ:ID:NO-562  DDSANSSEGP  NVSASMMDAM  KKINKDKVKA  ALEKRRS---  KGDLSICSQ  400
GI-77555729:SEQ:ID:NO-563   DVNRNGNDGT  NVTSLMVN--  KIDKDKVKA  QMEKQRK---  LKGDVARKVE  439
CLONE-33877:SEQ:ID:NO-556   PLQSY-----  ----------  ----------  --RQAGI--  ----------  316
ANNOT-1442675:SEQ:ID:NO-560 ELSSSSN AP  SYNSHH----  -NDVHQIRE  TLKRRRCQ A  AKSRASLSNE  392

CLONE-354406:SEQ:ID:NO-562  GCSAPLTYL  TAGKGL----  EPNKIKQERK  QSSPHVMHRG  DHRNADQVTG  416
GI-77555729:SEQ:ID:NO-563   VIDDDDDLER  QLEHDIELAV  ELQTAPSEKK  RKV-------  ----------  489
CLONE-33877:SEQ:ID:NO-556   W---------  ----------  ----------  ----------  ----------  317
ANNOT-1442675:SEQ:ID:NO-560 TMDAEL DET  WIERELEEGI  ----------  ----------  ----------  426

CLONE-354406:SEQ:ID:NO-562  NGHLGKQNTP  ETAQDAPMDD  IKEQRNSHGS  KHHDSHDTAH  ERGERDYKRP  416
GI-77555729:SEQ:ID:NO-563   ----------  ----------  ----------  ----------  ----------  543
CLONE-33877:SEQ:ID:NO-556   ----------  ----------  ----------  ----------  ----------  317
ANNOT-1442675:SEQ:ID:NO-560 ----------  ----------  ----------  ----------  ----------  426

CLONE-354406:SEQ:ID:NO-562  ----        416
GI-77555729:SEQ:ID:NO-563   RPEG        543
CLONE-33877:SEQ:ID:NO-556   ----        317
ANNOT-1442675:SEQ:ID:NO-560 ----        426
```

Figure 16

```
CLONE:848588:SEQ:ID:NO:567    ---MEAYM_FP RSNGKSCEEE QEEDTGCPSE SEV--SAAGS MLSSDEELDD    46
CLONE:1609830:SEQ:ID:NO:573   ---MMVMHMQ MGSSSLDQEN KIGFMGHDEE EDVYSSDASS VVSSDDESDH    47
CLONE:101876:SEQ:ID:NO:565    MHYQEQMESL MLGEERRRGN YTRDVDADSD EGV--NSPSS FPNSPDDSD-    47
CLONE:961460:SEQ:ID:NO:571    MHYQEQMESL MLGEERRREN CVRDADADTD EGF--NSPSS FPNSPDESD-    47

CLONE:848588:SEQ:ID:NO:567    D--ATSSSSS SGSTDNFQMS SLMAQLPLKR GLSKFFDGKS QSFASLAAVG    94
CLONE:1609830:SEQ:ID:NO:573   DDFEQSNSSS DNNHALGSMS DLDQLPSKR- GLSKHFQCKS QSFTSLSKVT    97
CLONE:101876:SEQ:ID:NO:565    ---RRSSSSS S--------- ------RR-- GLSKHYKGKS QSFTTLAEAL    77
CLONE:961460:SEQ:ID:NO:571    ---RRSSSSS ---------- ------RR-- GLSKHYRGKS QSFTSLSEAL    76

CLONE:848588:SEQ:ID:NO:567    GLEDLAKPIP ---GKRTKTSR SCE------- VGLQDAHRRR FARHNAAFK   134
CLONE:1609830:SEQ:ID:NO:573   CLEDLAKPEN PYNKKIKSCK SYAALSRVLP PPTRSASSSK FTKT---SSS   145
CLONE:101876:SEQ:ID:NO:565    TVEDLAKPEN PFNAKLKORR ESPHCRRL-- SCCGASERN- SVHD---VEL   123
CLONE:961460:SEQ:ID:NO:571    TVEDLAKPEN PLNAKLKQRR ESSHCRRL-- SGCGASQQN- ---------   115

CLONE:848588:SEQ:ID:NO:567    KVSKGRISAL GRAPPLRPLT ASAARPKGLP VRAPLFV               171
CLONE:1609830:SEQ:ID:NO:573   RASCSSLSNS SRPPTHPSHS NGAFSGCGFS NQTPLFV               182
CLONE:101876:SEQ:ID:NO:565    AGNDRPPRLS GNRPPPRAQT LSAAHISAL- TRI----               156
CLONE:961460:SEQ:ID:NO:571    ---------- ---------- ---------- -------               115
```

Figure 17

| | | | | | |
|---|---|---|---|---|---|
| GI-45387429-SEQ-ID-NO-598 | —MATNSSSHS | PRTVEEIFKD | FSARHAAVLR | ALTTDVEDFY | SQCDPERDNL | 49 |
| CLONE-1826835-SEQ-ID-NO-591 | —MTPASVSSN | PRSVEEIYKD | FSGRRAGLVR | ALTSDVDDFY | SSCDPDKENL | 49 |
| GI-34900462-SEQ-ID-NO-597 | MEMAAPVSPA | PRTVEDIFKD | FSGRRAGLVR | ALTHDVDEFY | GFCDPEKENL | 50 |
| CLONE-525628-SEQ-ID-NO-585 | ———MDMASS | ARTVEEIFKD | YSARRTSVIR | ALTKDVDHFY | GLCDPDKDNL | 46 |
| CLONE-1834120-SEQ-ID-NO-593 | ———MASS | PRTVEEIFKD | YTARRIAILR | ALTKDVDFFY | GLCDPDRENL | 44 |
| ANNOT-1511533-SEQ-ID-NO-577 | ———MASIQTS | PRTVEEIFKD | YSARRSALVR | ALTKDEADEVY | IQCDPEKENL | 47 |
| CLONE-156373-SEQ-ID-NO-575 | ———MAAAVSSN | PRTVEEIFKD | YSARRAALLR | ALTKDVDDFY | SQCDPEKENL | 49 |
| CLONE-1393778-SEQ-ID-NO-589 | ———MAAVSSN | PRTVEEIFKD | YTARRSALLR | ALTKDVDDFY | SQCDPEKENL | 47 |
| GI-75214624-SEQ-ID-NO-600 | —MEGGAALYN | PRTVEEVFKD | FKGRRAAIVK | ALTFDVQEFY | QQCDPEKENL | 49 |
| GI-12651665-SEQ-ID-NO-596 | —MEGMAQHPV | PRTVEEVFKD | YKGRRAGLIK | ALTTDVEKFY | QLVDPEKENL | 49 |
| GI-63028790-SEQ-ID-NO-599 | ———MENSV | PRTVEEVFSD | EKSRRAALIK | ALTIDVEKFY | QCCDPEKENL | 45 |

| | | | | | |
|---|---|---|---|---|---|
| GI-45387429-SEQ-ID-NO-598 | CLYGHPNESW | EVAVPAEEVP | PELPEPMLGI | NFARDGMERR | DWLSLVAMHT | 99 |
| CLONE-1826835-SEQ-ID-NO-591 | CLYGLPSGTW | AVAPPAEEVP | PEMPEPALGI | NFARDGMQRR | DWLSLVAVHS | 99 |
| GI-34900462-SEQ-ID-NO-597 | CLYGHPNGRM | EVALPAEEVP | PELPEPALGI | NFARDGMHRR | DWLSLVAVHS | 100 |
| CLONE-525628-SEQ-ID-NO-585 | CLYGHPNEAW | EVTLPAEEVP | AELPEPALGI | NFARDGMNRR | DWLSLVAVHS | 96 |
| CLONE-1834120-SEQ-ID-NO-593 | CLYGHPNESW | EVSLPAEEVP | PELPEPALGI | NFARDGMWRK | DWLSLVAVHS | 94 |
| ANNOT-1511533-SEQ-ID-NO-577 | CLYGHPTESW | EVDLPAEEVP | PELPEPALGI | NFARDGMSRK | DWLSLVAVHS | 97 |
| CLONE-156373-SEQ-ID-NO-575 | CLYGHPNESW | EVNLPAEEVP | PELPEPALGI | NFARDGMQRK | DWLSLVAVHS | 99 |
| CLONE-1393778-SEQ-ID-NO-589 | CLYGHPNESW | EVNLPAEEVP | PELPEPALGI | NFARDGMQRK | DWLSLVAVHS | 97 |
| GI-75214624-SEQ-ID-NO-600 | CLYGLPNEEM | EVNLPAEEVP | PELPEPALGI | NFARDGLEEK | EWLSLVAIHS | 99 |
| GI-12651665-SEQ-ID-NO-596 | CLYGFPNETW | EVNLPVEEVP | PELPEPALGI | NFARDGMQEK | DWLSLVAVHS | 99 |
| GI-63028790-SEQ-ID-NO-599 | CLYGLPNETW | EVNLPVEEVP | PELPEPALGI | NFARDGMQEK | DWLSLVAVHS | 95 |

| | | | | | |
|---|---|---|---|---|---|
| GI-45387429-SEQ-ID-NO-598 | DSWLLSVAFY | FGARLN——RN | ERSRVFTLIN | DLPTVFEAVT | GR—RPLKD-K | 145 |
| CLONE-1826835-SEQ-ID-NO-591 | DSWLISVAFF | FGARLN——AN | DRKRLFSMVS | DLPSVFEAFS | DR—KHGRD-R | 145 |
| GI-34900462-SEQ-ID-NO-597 | DSWLLSVAFF | FGARLN——GN | ERKRLFSLIN | DLPSVFEVTT | DR—KHGRDNK | 147 |
| CLONE-525628-SEQ-ID-NO-585 | DSWLVSVAFY | LGARLN——RN | ERKRLFSLIN | DLPSVFEVVT | DR—KPVKD-K | 142 |
| CLONE-1834120-SEQ-ID-NO-593 | DSWLISLAFY | LAARLN——RN | ERKRLFSMMN | DLPTLFEIVT | ER—KPAED-K | 140 |
| ANNOT-1511533-SEQ-ID-NO-577 | DSWLISMAFY | FGARLN——RN | DRKRLFSMIN | DLPTLFDVVT | GR—KPVKD-K | 143 |
| CLONE-156373-SEQ-ID-NO-575 | DCWLLSVSFY | FGARLN——RN | DRKRLFSLIN | DLPTLFDVVT | GR—KAMKDNK | 146 |
| CLONE-1393778-SEQ-ID-NO-589 | DCWLLSVSFY | FGSRFSFHKE | DRKRLFNMIN | DVPTIFEVVT | GR—KPIDNK | 144 |
| GI-75214624-SEQ-ID-NO-600 | DAWLLSVAVY | FGARFGFGKN | DRKRLFQMIN | DLPTLFELAT | GMAKKQSKDK | 149 |
| GI-12651665-SEQ-ID-NO-596 | DSWLLSVAFY | FGARFGFGKS | DRKRLFQMIN | DLPTVFEVVT | GTAKQSKD-L | 149 |
| GI-63028790-SEQ-ID-NO-599 | DSWLLSVAFY | FGARFGFGKS | DRKRLFQMIN | DLPTVFEVVT | GAAKQTRD— | 143 |

Figure 17 - continued

NUCLEOTIDE SEQUENCES AND CORRESPONDING POLYPEPTIDES CONFERRING AN ALTERED FLOWERING TIME IN PLANTS

This application is a national phase under 35 U.S.C. §371 of PCT International Application No. PCT/US2007/006651, which has an International filing date of Mar. 14, 2007, and which claims priority to U.S. Provisional Application Nos. 60/782,428 filed Mar. 14, 2006 and 60/821,639 filed Aug. 7, 2006, the entire contents of which are hereby incorporated by reference.

FIELD OF THE INVENTION

The present invention relates to isolated nucleic acid molecules and their corresponding encoded polypeptides able to confer the trait of altered flowering time in plants. The present invention further relates to using the nucleic acid molecules and polypeptides to make transgenic plants or plant cells, plant materials or seeds of a plant capable of producing plants having flowering times that are altered with respect to wild-type plants grown under similar conditions. Altered flowering time includes both plants having an early flowering time and a late flowering time with respect to wild-type plants grown under similar conditions. Flowering time in plants may be altered either due to change of the timing of the developmental transition from vegetative to reproductive growth or because of acceleration or prolonging of the entire life cycle of the plant with respect to wild-type plants using the nucleic acid molecules and polypeptides of the present invention.

BACKGROUND OF THE INVENTION

The life cycle of plants is highly regulated at the genetic level and very sensitive to environmental variables, such as day length and temperature (Koomneef et al. (1998) *Annu. Rev. Plant. Physiol. Mol. Biol.,* 49: 345-370). Plant life cycles are complex and must be regulated to maximize chances of survival. There must be a careful balance of investment of time in various stages of the life cycle of a plant, such as dormancy, germination, reproduction, vegetative growth and maturation, to insure survival. To implement this balance, each of these stages requires the expression or repression of various genes or groups of genes.

The life cycle of flowering plants in general can be divided into three growth phases: vegetative, reproductive, and seed development. In the vegetative phase, the shoot apical meristem (SAM) generates leaves that later will ensure the resources necessary to produce fertile offspring. Upon receiving the appropriate environmental and developmental signals the plant switches to floral, or reproductive, growth and the SAM enters the inflorescence phase and gives rise to an inflorescence with flower primordia. During this phase the fate of the SAM and the secondary shoots that arise in the axils of the leaves is determined by a set of meristem identity genes, some of which prevent and some of which promote the development of floral meristems. Once the floral organs are produced and fruits are formed, the plant enters seed development phase (Xu et al. (1995) *Plant Mol. Biol.* 27.237). If the appropriate environmental and developmental signals that induce the plant to switch to floral, or reproductive, growth are disrupted, the plant will not be able to enter reproductive growth, and will maintain vegetative growth.

Temporal coordination of life cycle stages depends on factors such as energy requirements, environmental variables and reproductive strategy. Maximization of any one life cycle period or stage is usually at the cost of one of the other periods or stages in the life cycle. For instance, trade-offs exist between the initiation of the reproductive growth stage and the length of the vegetative growth stage, the early flowering and the later growth and reproduction stages. The transition of a plant from a vegetative growth stage into a reproductive, or flowering, stage is pivotal because the fitness of a plant, and therefore its chances of survival, can be highly sensitive to this transition.

Thus, early flowering in plants can provide discernable advantages over other later flowering plants. For instance, early flowering usually results in early maturity and eventually shortens growth duration from sowing to harvest in plants. This allows farmers to avoid environmental adversity, such as freezing temperatures, in the early or later growing seasons at high latitude or altitude. This competitive advantage can also help crop rotation schedules. Alternatively, if cold weather or crop rotation is not a problem, later flowering has other advantages, such as a robust vegetative state, yielding higher amounts of plant material.

These advantages to the plant also translate into economic and production advantages providing more efficient human use of plants and especially plant crops critical to human survival. Generally, early flowering plants have smaller plant stature due to shortened vegetative growth compared to wild-type plants. Small plant stature is desirable in some cases. However, technologies enabling alteration of the moment within the life cycle at which a plant flowers are more advantageous if this alteration is accomplished without other disadvantageous trade-offs, such as a reduction in plant mass or other changes in phenotypically discernable traits.

Availability and maintenance of a reproducible stream of food to feed people has been a high priority throughout the history of human civilization. Specialists and researchers in the fields of crop science, horticulture and forest science are even today constantly striving to find and produce plants with an increased growth potential to feed an increasing world population and to guarantee a supply of reproducible raw materials. The robust level of research in these fields of science indicates the level of importance leaders in every geographic environment and climate around the world place on providing sustainable sources of food for their people.

Manipulation of crop performance has been accomplished conventionally for centuries through selection and plant breeding. The breeding process is, however, both time-consuming and labor-intensive. Furthermore, appropriate breeding programs must be specially designed for each relevant plant species.

On the other hand, great progress has been made in using molecular genetics approaches to manipulate plants to provide better crops. Through introduction and expression of recombinant nucleic acid molecules in plants, researchers are now poised to provide people with plant species tailored to grow more efficiently and produce more product despite unique geographic and/or climatic environments. These new approaches have the additional advantage of not being limited to one plant species, but instead being applicable to multiple different plant species (Zhang et al. (2004) *Plant Physiol.* 135:615).

Despite this progress, today there continues to be a great need for generally applicable processes that improve forest or agricultural plant growth to suit particular needs depending on specific environmental conditions. To this end, the present invention is directed to advantageously manipulating plant life cycles to maximize the benefits of various crops depending on the benefit sought and the particular environment in which the crop must grow, characterized by expression of recombinant DNA molecules in plants. These molecules may be from the plant itself, and simply expressed at a higher or lower level, or the molecules may be from different plant species, providing advantages from one species to another allowing the new plant species to better adapt to a challenging geographic or climatic environment.

SUMMARY OF THE INVENTION

The present invention, therefore, relates to isolated nucleic acid molecules and polypeptides and their use in making transgenic plants or plant cells, plant materials or seeds of plants capable of generating plants having life cycles, particularly flowering times, that are altered with respect to wild-type plants grown under similar or identical conditions.

Unless otherwise defined, all technical and scientific terms used herein have the same meaning as commonly understood by one of ordinary skill in the art to which this invention belongs.

BRIEF DESCRIPTION OF THE FIGURES

FIG. 1. Amino acid sequence alignment of homologues of Clone 241491 transformed in ME08427 (SEQ ID NO: 95). Conserved regions are enclosed in a box.

FIG. 2. Amino acid sequence alignment of homologues of Clone 246416 transformed in ME03153 (SEQ ID NO: 139). Conserved regions are enclosed in a box.

FIG. 3. Amino acid sequence alignment of homologues of Clone 1010174 transformed in ME04928 (SEQ ID NO: 195). Conserved regions are enclosed in a box.

Figure 4:
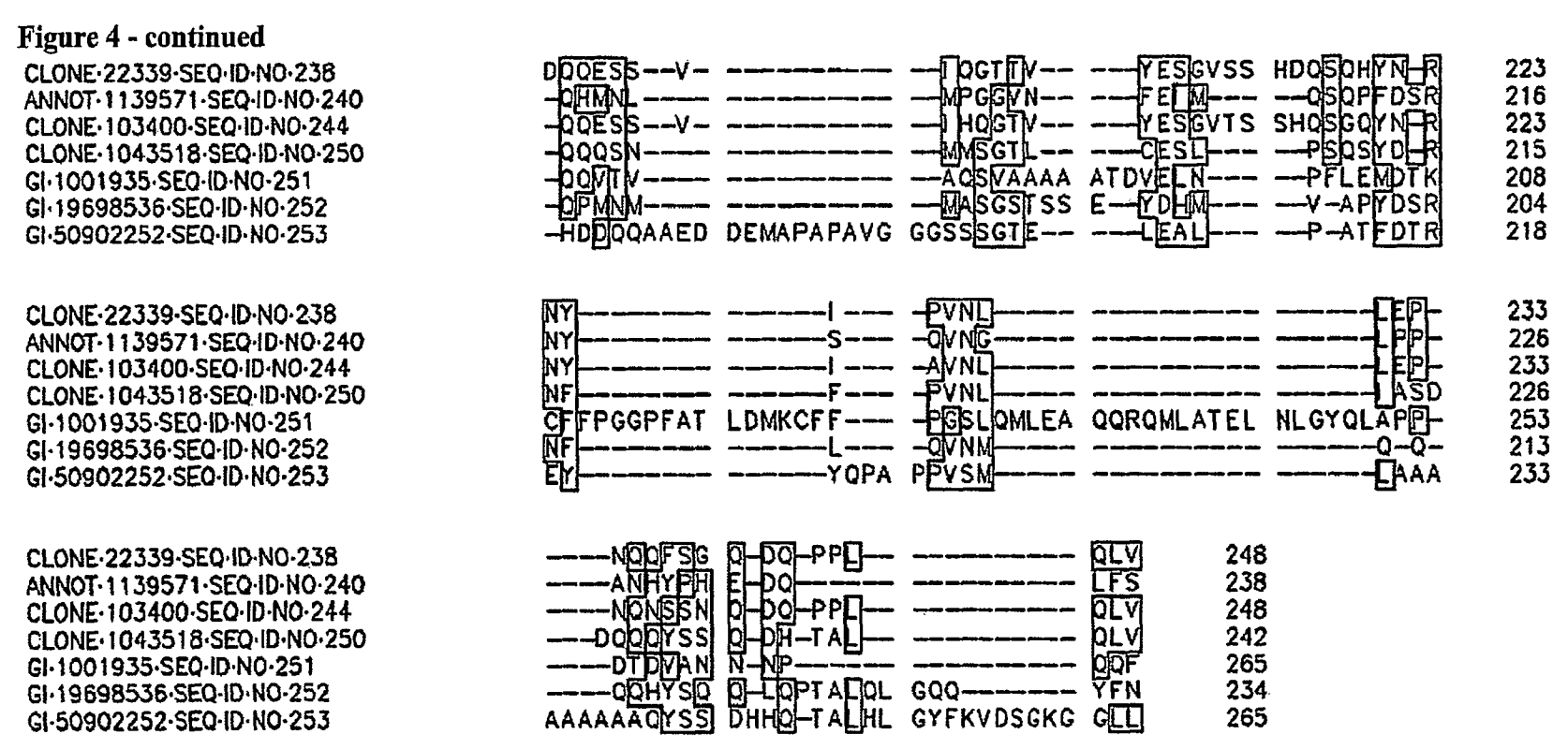

FIG. 4. Amino acid sequence alignment of homologues of Clone 22339 transformed in ME04522 (SEQ ID NO: 237). Conserved regions are enclosed in a box.

FIG. 5. Amino acid sequence alignment of homologues of Clone 13660 transformed in ME07393 (SEQ ID NO: 284). Conserved regions are enclosed in a box.

FIG. 6. Amino acid sequence alignment of homologues of Clone 708396 (SEQ ID NO: 298) transformed in ME03198, Clone 231890 (SEQ ID NO: 319) transformed in ME11261 and Clone 101876 (SEQ ID NO:564) transformed in ME04402. Conserved regions are enclosed in a box.

FIG. 7. Amino acid sequence alignment of homologues of At1g21340 transformed in ME11030 (Lead 107; SEQ ID NO: 326). Conserved regions are enclosed in a box.

FIG. 8. Amino acid sequence alignment of homologues of At2g44680 transformed in ME09573 (SEQ ID NO: 341). Conserved regions are enclosed in a box.

FIG. 9. Amino acid sequence alignment of homologues of Clone 32842 transformed in ME05718 (SEQ ID NO: 383). Conserved regions are enclosed in a box.

FIG. 10. Amino acid sequence alignment of homologues of Clone 251923 transformed in ME02194 (SEQ ID NO: 400). Conserved regions are enclosed in a box.

FIG. 11. Amino acid sequence alignment of homologues of Clone 149496 transformed in ME03847 (SEQ ID NO: 435). Conserved regions are enclosed in a box.

FIG. 12. Amino acid sequence alignment of homologues of Clone 21240 transformed in ME06492 (SEQ ID NO: 449). Conserved regions are enclosed in a box.

FIG. 13. Amino acid sequence alignment of homologues of Clone 19080 transformed in ME06561 (SEQ ID NO: 463). Conserved regions are enclosed in a box.

FIG. 14. Amino acid sequence alignment of homologues of Clone 33231 transformed in ME03027 (SEQ ID NO: 472). Conserved regions are enclosed in a box.

FIG. 15. Amino acid sequence alignment of homologues of Clone 33877 transformed in ME05742 (SEQ ID NO: 555). Conserved regions are enclosed in a box.

FIG. 16 Amino acid sequence alignment of homologues of clone 100516 (SEQ ID NO: 321). Conserved regions are enclosed in a box.

FIG. 17 Amino acid sequence alignment of homologues of clone 156373 (SEQ ID NO: 574). Conserved regions are enclosed in a box.

DETAILED DESCRIPTION OF THE INVENTION

1. The Invention

The invention of the present application may be described by, but not necessarily limited to, the following exemplary embodiments.

The present invention discloses novel isolated nucleic acid molecules, nucleic acid molecules that interfere with these isolated nucleic acid molecules, nucleic acid molecules that hybridize to these nucleic acid molecules, and isolated nucleic acid molecules that encode the same protein due to the degeneracy of the DNA code. Additional embodiments of the present application further include the polypeptides encoded by the isolated nucleic acid molecules of the present invention.

More particularly, the nucleic acid molecules of the present invention comprise: (a) a nucleotide sequence that encodes an amino acid sequence that is at least 85% identical to any one of the amino acid sequences in the sequence listing (SEQ ID NOS: 96, 140, 196, 238, 285, 299, 327, 342, 384, 401, 436, 320, 450, 464, 473, 556, 384, 399, 322, 565 and 575), (b) a nucleotide sequence that is complementary to any one of the nucleotide sequences according to (a), (c) a nucleotide sequence according to any one of SEQ ID NOS. 95, 139, 195, 237, 284, 298, 326, 341, 383, 400, 435, 319, 449, 463, 472, 555, 383, 398, 321, 564 and 574, (d) a nucleotide sequence able to interfere with any one of the nucleotide sequences according to (a), (e) a nucleotide sequence able to form a hybridized nucleic acid duplex with the nucleic acid according to any one of paragraphs (a)-(d) at a temperature from about 5° C. to about 10° C. below a melting temperature of the hybridized nucleic acid duplex, (f) a nucleotide sequence encoding any one of amino acid sequences corresponding to SEQ ID NOS. 96, 140, 196, 238, 285, 299, 327, 342, 384, 401, 436, 320, 450, 464, 473, 556, 384, 399, 322, 565 and 575, and (g) a nucleotide sequence encoding any one of the amino acid sequences that fits an HMM based on the sequences aligned in any one of FIGS. 1-17 with an HMM bit score greater than 20.

Additional embodiments of the present invention include those polypeptide and nucleic acid molecule sequences disclosed in SEQ ID NOS: 95-601.

Another embodiment of the present invention may additionally comprise amino acid sequences that are at least 85% identical to any one of SEQ ID Nos. 96, 140, 196, 238, 285, 299, 327, 342, 384, 401, 436, 320, 450, 464, 473, 556, 384, 399, 322, 565 and 575.

The present invention further embodies a vector comprising a first nucleic acid having a nucleotide sequence encoding a plant transcription and/or translation signal, and a second nucleic acid having a nucleotide sequence according to the isolated nucleic acid molecules of the present invention. More particularly, the first and second nucleic acids may be operably linked. Even more particularly, the second nucleic acid may be endogenous to a first organism, and any other nucleic acid in the vector may be endogenous to a second organism. Most particularly, the first and second organisms may be different species.

In a further embodiment of the present invention, a host cell may comprise an isolated nucleic acid molecule according to the present invention. More particularly, the isolated nucleic acid molecule of the present invention found in the host cell of the present invention may be endogenous to a first organism and may be flanked by nucleotide sequences endogenous to a second organism. Further, the first and second organisms may be different species. Even more particularly, the host cell of the present invention may comprise a vector according to the present invention, which itself comprises nucleic acid molecules according to those of the present invention.

Other embodiments of the present invention include methods of introducing an isolated nucleic acid of the present invention into a host cell. More particularly, an isolated nucleic acid molecule of the present invention may be contacted to a host cell under conditions allowing transport of the isolated nucleic acid into the host cell. Even more particularly, a vector as described in a previous embodiment of the present invention, may be introduced into a host cell by the same method.

Methods of detection are also available as embodiments of the present invention. Particularly, methods for detecting a nucleic acid molecule according to the present invention in a sample. More particularly, the isolated nucleic acid molecule according to the present invention may be contacted with a sample under conditions that permit a comparison of the nucleotide sequence of the isolated nucleic acid molecule with a nucleotide sequence of nucleic acid in the sample. The results of such an analysis may then be considered to determine whether the isolated nucleic acid molecule of the present invention is detectable and therefore present within the sample.

A further embodiment of the present invention comprises a plant or a plant cell, plant material or seeds of plants comprising an isolated nucleic acid molecule and/or vector of the present invention. More particularly, the isolated nucleic acid molecule of the present invention may be exogenous to the plant, plant cell, plant material or seed of a plant.

A further embodiment of the present invention includes a plant regenerated from a plant cell or seed according to the present invention. More particularly, the plant, or plants derived from the plant, plant cell, plant material or seeds of a plant of the present invention flowers early as compared to a wild-type plant cultivated under identical conditions. Furthermore, the transgenic plant may comprise a first isolated nucleic acid molecule of the present invention, which encodes an early flowering component, and a second isolated nucleic acid molecule which functions as a plant promoter, wherein the early flowering component and the plant promoter are operably linked. Alternatively, the early flowering component may be mis-expressed in the transgenic plant of the present invention, and the transgenic plant exhibits an earlier flowering time than a progenitor plant devoid of the gene, when the transgenic plant and the progenitor plant are cultivated under identical environmental conditions. In another embodiment of the present invention the modulated growth and phenotype characteristics may be due to the inactivation of a particular sequence, using such techniques as, for example, an interfering RNA.

A further embodiment consists of a plant, plant cell, plant material or seed of a plant according to the present invention which comprises an isolated nucleic acid molecule of the present invention, wherein the plant, or plants derived from the plant, plant cell, plant material or seed of a plant, flowers earlier than a wild-type plant cultivated under identical conditions.

Another embodiment of the present invention includes methods of inducing altered flowering time in plants. These methods may comprise transforming a plant with an isolated nucleic acid molecule according to the present invention.

Polypeptides of the present invention include sequences belonging to the consensus sequence families shown in FIGS. 1 to 17 as delineated by Hidden Markov Models (HMMs).

2. Definitions

The following terms are utilized throughout this application:

Altered flowering time: Altered flowering time may mean either that: (a) flowering time of a plant is earlier than a wild-type plant (i.e., early flowering) or (b) the flowering time is later than a wild-type plant (i.e., late flowering).

Early Flowering: Plant species vary in the temporal lengths of their life cycles. Plants can have life cycles that may be completed within one year or span across several years. Plants generally flower late in their life cycle, after embryogenesis, seedling development and a period of vegetative growth (Walbot (1985) *Trends Genet.* 1:165-169.). Flowering time in plants is influenced by many endogenous and environmental factors, including gibberellin biosynthesis and signaling, autonomous controls, light quality and intensity, photoperiod, temperature, and availability of nutrients (Garner and Allard (1920) *J. Agric. Res.* 18:553-606; Bernier (1988) *Annu. Rev. Plant Physiol.* 39:175-219; Millar (1999) *New Phytol.* 14:175-197.; Battey (2000) *J. Exp. Bot.* 51:1769-1780; Samach and Coupland (2000) *Bioessay,* 22:38-47.). Early flowering may mean: (a) that the plant has begun to flower at a time statistically significantly earlier than a wild-type plant, grown under the same conditions because the transition from the vegetative, pre-flowering phase to the reproduction phase occurs earlier; or that the plant has begun to flower at a time statistically significantly earlier than a wild-type plant grown under the same conditions because the growth rate of the plant prior to flowering and/or in the entire life cycle has been enhanced.

Early flowering may also be described as a plant flowering at a moment in its life cycle that is at least 1% and 10% earlier in the plant's life cycle compared to a corresponding wild-type plant grown under identical conditions. Alternatively, the plant may begin to flower at a moment in the plant's life cycle that is at least 10% to 25% earlier or at least 25% and 50% earlier or at least 50% and 99% earlier.

Early Maturity: Seeds or fruits are formed after a plant flowers. Seeds or fruits undergo the processes of formation, development, in some cases desiccation, and maturation. Maturation means that the growth and development of the seed or fruit has been fulfilled such that it is ready for harvesting for consumption and/or reproducing the next generation of plants.

Early maturity may also be described as the seed or fruit of a plant maturing at a moment in its life cycle that is at least 1% to 10% earlier in the plant's life cycle compared to a corresponding wild-type plant grown under identical conditions. Alternatively, the seed or fruit may begin to mature at a moment in the plant's life cycle that is at least 2% to 5% earlier, 10% to 25% earlier or at least 25% to 50% earlier or at least 50% to 99% earlier.

Functionally Comparable Proteins: Functionally Comparable Proteins or Functional Homologs This phrase describes a set of proteins that perform similar functions within an organism. By definition, perturbation of an individual protein within that set (through misexpression or mutation, for example) is expected to confer a similar phenotype as compared to perturbation of any other individual protein. Such proteins typically share sequence similarity resulting in similar biochemical activity. Within this definition, homologs, orthologs and paralogs are considered to be functionally comparable.

Functionally comparable proteins will give rise to the same characteristic to a similar, but not necessarily the same, degree. Typically, comparable proteins give the same characteristics where the quantitative measurement due to one of the comparables is at least 20% of the other; more typically, between 30 to 40%; even more typically, between 50-60%; even more typically between 70 to 80%; even more typically between 90 to 100% of the other.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence, are considered heterologous to said coding sequence. Elements operatively linked in nature and contiguous to each other are not heterologous to each other. On the other hand, these same elements remain operatively linked but become heterologous if other filler sequence is placed between them. Thus, the promoter and coding sequences of a corn gene expressing an amino acid transporter are not heterologous to each other, but the promoter and coding sequence of a corn gene operatively linked in a novel manner are heterologous.

Hidden Markov Model (HMM): HMM is a statistical description of a sequence family's consensus. The model is indicative of similarity of a polypeptide sequence to a group of structurally and functionally related polypeptides (Durbin, R., Eddy, S. R., Krogh, A. & Mitchison, G. J. *Biological Sequence Analysis. Probabilistic Models of Proteins and Nucleic Acids* Cambridge University Press, Cambridge UK, 1998).

HMM based on specified sequences: An HMM profile based on specified sequences is the output model generated by the program HMMER 2.3.2 (released Oct. 3, 2003 under a GNU general public license, and available from various sources on the internet, such as the "HMMER" website) configured with default parameters, the model being built by the program using the specified sequences as input. The program outputs the model as a text file.

HMM bit score: An HMM bit score is a probabilistic indication of confidence that a sequence fits the model. The bit score reflects whether the sequence is a better fit to an HMM of interest than to a null model of nonhomologous sequences. A significant HMM bit score is greater than zero, but is typically greater than 20. The HMM bit score of a polypeptide sequence fitted to an HMM profile can be determined by fitting the polypeptide to the HMM with program HMMER 2.3.2 configured for glocal alignments.

Late flowering: In contrast to early flowering, late flowering may mean: (a) that the plant has begun to flower at a time statistically significantly later than a wild-type plant, grown under the same conditions because the transition from the vegetative, pre-flowering phase to the reproduction phase occurs later; or that the plant has begun to flower at a time statistically significantly later than a wild-type plant, grown under the same conditions because the growth rate of the plant prior to flowering and/or in the entire life cycle has been decreased.

Late flowering can also be described as a plant flowering at a moment in its life cycle that is at least 1% and 10% later in the plant's life cycle compared to a corresponding wild-type plant grown under identical conditions. Alternatively, the plant may begin to flower at a moment in the plant's life cycle that is at least 10% to 25% later or at least 25% and 50% later or at least 50% and 99% later.

Misexpression: The term "misexpression" refers to an increase or a decrease in the transcription of a coding region into a complementary RNA sequence as compared to transcription in the wild-type plant. This term also encompasses expression and/or translation of a gene or coding region or inhibition of such transcription and/or translation for a different time period as compared to that in the wild-type plant and/or from a non-natural location within the plant genome, including a gene coding region from a different plant species or from a non-plant organism.

Percentage of sequence identity: As used herein, the term "percent sequence identity" refers to the degree of identity between any given query sequence and a subject sequence. A subject sequence typically has a length that is from about 80 percent to 250 percent of the length of the query sequence, e.g., 82, 85, 87, 89, 90, 93, 95, 97, 99, 100, 105, 110, 115, or 120, 130, 140, 150, 160, 170, 180, 190, 200, 210, 220, 230, 240, or 250 percent of the length of the query sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chema et al. (2003) *Nucleic Acids Res.* 31(13): 3497-500.

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For an alignment of multiple nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher website and at the European Bioinformatics Institute website on the World Wide Web.

To determine a percent identity for polypeptide or nucleic acid sequences between a query and a subject sequence, the sequences are aligned using Clustal W and the number of identical matches in the alignment is divided by the query length, and the result is multiplied by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

Plant Stature Generally, the whole plant body is comprised of the above-ground portion known as the shoot and the underground portion known as the root. The shoot may consist of stems, leaves, flowers, fruits, and other organs. The size and number of these plant organs determine the stature of the plant. Usually, plants with smaller stature than the wild-type plant produces less biomass than the wild-type plant.

Regulatory Regions The term "regulatory region" refers to nucleotide sequences that, when operably linked to a sequence, influence transcription initiation or translation initiation or transcription termination of said sequence and the rate of said processes, and/or stability and/or mobility of a transcription or translation product. As used herein, the term "operably linked" refers to positioning of a regulatory region and said sequence to enable said influence. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns. Regulatory regions can be classified in two categories, promoters and other regulatory regions.

Stringency: "Stringency," as used herein is a function of nucleic acid molecule probe length, nucleic acid molecule probe composition (G+C content), salt concentration, organic solvent concentration and temperature of hybridization and/or wash conditions. Stringency is typically measured by the parameter $T_m$, which is the temperature at which 50% of the complementary nucleic acid molecules in the hybridization assay are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship between hybridization conditions and $T_m$ (in ° C.) is expressed in the mathematical equation:

$$T_m=81.5-16.6(\log_{10}[Na^+])+0.41(\% G+C)-(600/N) \quad (I)$$

where N is the number of nucleotides of the nucleic acid molecule probe. This equation works well for probes 14 to 70 nucleotides in length that are identical to the target sequence. The equation below, for $T_m$ of DNA-DNA hybrids, is useful for probes having lengths in the range of 50 to greater than 500 nucleotides, and for conditions that include an organic solvent (formamide):

$$T_m=81.5+16.6 \log\{[Na^+]/(1+0.7[Na^+])\}+0.41(\% G+C)-500/L\ 0.63(\% \text{formamide}) \quad (II)$$

where L represents the number of nucleotides in the probe in the hybrid (Bonner et al. (1973) *J. Mol. Biol.* 81:123). The $T_m$ of Equation II is affected by the nature of the hybrid: for DNA-RNA hybrids, $T_m$ is 10-15° C. higher than calculated; for RNA-RNA hybrids, $T_m$ is 20-25° C. higher. Because the $T_m$ decreases about 1° C. for each 1% decrease in homology when a long probe is used (Frischauf et al. (1983) *J. Mol Biol*, 170: 827-842), stringency conditions can be adjusted to favor detection of identical genes or related family members.

Equation II is derived assuming the reaction is at equilibrium. Therefore, hybridizations according to the present invention are most preferably performed under conditions of probe excess and allowing sufficient time to achieve equilibrium. The time required to reach equilibrium can be shortened by using a hybridization buffer that includes a hybridization accelerator such as dextran sulfate or another high volume polymer.

Stringency can be controlled during the hybridization reaction, or after hybridization has occurred, by altering the salt and temperature conditions of the wash solutions. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

For example, the hybridization step may be performed in aqueous hybridization solution at a temperature between 63° C. and 70° C., more preferably at a temperature between 65° C. and 68° C. and most preferably at a temperature of 65° C. Alternatively, the high stringency hybridization step may be performed in formamide hybridization solution at a temperature between 40° C. and 46° C., at a temperature between 41° C. and 44° C. and most preferably at a temperature of 42° C.

A wash step follows hybridization, and an initial wash is performed with wash solution 1 at 25° C. or 37° C. Following the initial wash, additional washes are performed with wash solution 1 at a temperature between 63° C. and 70° C., more preferably at a temperature between 65° C. and 68° C. and most preferably at a temperature of 65° C. The number of additional wash steps can be 1, 2, 3, 4, 5 or more. The time of both the initial and additional wash steps may be 5 minutes, 10 minutes, 15 minutes, 20 minutes, 25 minutes, 30 minutes, 45 minutes, 1 hour, 1.5 hours, 2 hours or more.

Set forth below are the composition of the hybridization and wash solutions and their components. A person of ordinary skill in the art will recognize that these solutions are typical and exemplary of high stringency hybridization solutions.

Aqueous Hybridization Solution: 6×SSC or 6×SSPE
   0.05% Blotto or 5×Denhardt's Reagent
   100 µg/ml denatured salmon sperm DNA
   0.05% SDS
Formamide Hybridization Solution: 50% Formamide
   6×SSC or 6×SSPE
   0.05% Blotto or 5×Denhardt's Reagent
   100 µg/ml denatured salmon sperm DNA
   0.05% SDS
Wash Solution 1: 2×SSC or SSPE
   0.1% SDS
Wash Solution 2: 0.1×SSC or SSPE
   0.5% SDS
20×SSC: 175.3 g NaCl
   88.2 g Sodium Citrate
   Bring to 800 ml with $H_2O$
   Adjust to pH 7 with 10 n NaOH
   Bring to 1 L with $H_2O$
20×SSPE: 175.3 g NaCl
   27.6 g $NaH_2PO_4$
   Bring to 800 ml with $H_2O.H_2O$
   7.4 g EDTA
   Adjust to pH 7.4 with 10 n NaOH
   Bring to 1 L with $H_2O$
1×BLOTTO: 5% Non-fat dry milk
   0.02% Sodium azide
50×Denhardts's Reagent: 5 g Ficoll
   5 g Polyvinylpyrrolidone
   5 g BSA
   Adjust to 500 ml with $H_2O$ Superpool: As used in the context of the current invention, a "superpool" contains an equal amount of seed from 500 different events, representing 100 distinct exogenous nucleotide sequences. An event is a plant carrying a unique insertion of a distinct exogenous sequence which misexpresses that sequence. Transformation of a single polynucleotide sequence can result in multiple events because the sequence can insert in a different part of the genome with each transformation.

$T_0$: The term "$T_0$" refers to the whole plant, explant or callus tissue, inoculated with the transformation medium.

$T_1$: The term $T_1$ refers to either the progeny of the $T_0$ plant, in the case of whole-plant transformation, or the regenerated seedling in the case of explant or callous tissue transformation.

$T_2$: The term $T_2$ refers to the progeny of the $T_1$ plant. $T_2$ progeny are the result of self-fertilization or cross-pollination of a $T_1$ plant.

$T_3$: The term $T_3$ refers to second generation progeny of the plant that is the direct result of a transformation experiment. $T_3$ progeny are the result of self-fertilization or cross-pollination of a $T_2$ plant.

$T_4$: As used in the current application, the term $T_4$ refers to third generation progeny of the plant that is the direct result of a transformation experiment. $T_4$ progeny are the result of self-fertilization or cross pollination of a $T_3$ plant.

Transformation: Examples of means by which this can be accomplished are described below and include *Agrobacterium*-mediated transformation (of dicots (Needleman and Wunsch (1970) *J. Mol. Biol.* 48:443; Pearson and Lipman (1988) *Proc. Natl. Acad. Sci.* (USA) 85:2444), of monocots (Yamauchi et al. (1996) *Plant Mol. Biol.* 30:321-9; Xu et al. (1995) *Plant Mol. Biol.* 27:237; Yamamoto et al. (1991) *Plant Cell* 3:371), and biolistic methods (P. Tijessen, "Hybridization with Nucleic Acid Probes" In Laboratory Techniques in Biochemistry and Molecular Biology, P. C. vand der Vliet, ed., c. 1993 by Elsevier, Amsterdam), electroporation, in planta techniques and the like. Such a plant containing the exogenous nucleic acid is referred to here as a $T_0$ for the primary transgenic plant and $T_1$ for the first generation.

3. Important Characteristics of the Polynuceotides and Polypeptides of the Invention The nucleic acid molecules and polypeptides of the present invention are of interest because when the nucleic acid molecules are misexpressed (i.e., when expressed at a non-natural location or in an increased or decreased amount relative to wild-type) they produce plants that exhibit an altered flowering time with respect to wild-type plants, as evidenced by the results of various experiments disclosed below. This trait can be used to exploit or maximize plant products. For example, the nucleic acid molecules and polypeptides of the present invention are used to increase the expression of genes that cause the plant to flower earlier or decrease the expression of genes that may cause the plant to flower later than the wild-type plant. As a consequence, these transgenic plants produce seed more quickly and/or exhibit altered biomass production characteristics that may be useful in certain climates and geographic regions.

As more and more transgenic plants are developed and introduced into the environment, it can be important to control the undesired spread of the transgenic trait(s) from transgenic plants to other traditional and transgenic cultivars, plant species and breeding lines, thereby preventing cross-contamination. The use of a conditionally lethal gene, i.e. one which results in plant cell death under certain conditions, has been suggested as a means to selectively kill plant cells containing a recombinant DNA (see e.g., WO 94/03619 and US patent publication 20050044596A1). Polypeptides comprised of a sequence belonging to the consensus sequence families shown in FIGS. 1 to 17 as delineated by HMMs can be utilized for the purposes of the invention, namely to make transgenic plants with altered flowering times.

Male or female sterile genes can also be used to control the spread of certain germplasm, such as by selective destruction of tissue, such as of the tapetum by fusing such a gene to a tapetum-specific promoter such as, TA29. Further examples of such promoters are described below.

4. The Polynucleotides/Polypeptides of the Invention

The polynucleotides of the present invention and the proteins expressed via translation of these polynucleotides are set forth in the Sequence Listing, specifically, SEQ ID NOS: 95-601. The Sequence Listing consists of functionally comparable proteins. Polypeptides comprised of a sequence within and defined by one of the consensus sequences in FIGS. 1 to 17 can be utilized for the purposes of the invention, namely to make transgenic plants with altered flowering times.

5. Use of the Polynucleotides to Make Transgenic Plants

The nucleic acid molecules of the present invention encode appropriate proteins from any organism, but may be found, for instance, in plants, fungi, bacteria or animals.

The nucleic acid molecules of the present invention may be used to confer the trait of an altered flowering time.

To use the sequences of the present invention or a combination of them or parts and/or mutants and/or fusions and/or variants of them, recombinant DNA constructs are prepared that comprise the polynucleotide sequences of the invention inserted into a vector and that are suitable for transformation of plant cells. The construct can be made using standard recombinant DNA techniques (Sambrook et al, Molecular Cloning: A Laboratory Manual, Second Edition, Cold Spring Harbor Laboratory Press, 1989, New York.) and can be introduced into the plant species of interest by, for example, *Agrobacterium*-mediated transformation, or by other means of transformation, for example, as disclosed below.

The vector backbone may be any of those typically used in the field such as plasmids, viruses, artificial chromosomes, BACs, YACs, PACs and vectors such as, for instance, bacteria-yeast shuttle vectors, lamda phage vectors, T-DNA fusion vectors and plasmid vectors (Shizuya et al. (1992) *Proc. Natl. Acad. Sci. USA*, 89:8794-8797; Hamilton et al. (1996) *Proc. Natl. Acad. Sci. USA*, 93:9975-9979; Burke et al. (1987) *Science* 236:806-812); Sternberg N. et al. (1990) *Proc Natl. Acad. Sci. USA*, 87:103-7; Bradshaw et al., (1995) *Nucl. Acids Res.* 23, 4850-4856; Frischauf et al. (1983) *J. Mol. Biol*, 170:827-842; Huynh et al., Glover N. Mex. (ed) DNA Cloning: A practical Approach, Vol. 1, Oxford: IRL Press (1985); Walden et al. (1990) *Mol. Cell. Biol.* 1: 175-194).

Typically, the construct comprises a vector containing a nucleic acid molecule of the present invention with any desired transcriptional and/or translational regulatory sequences such as, for example, promoters, UTRs, and 3' end termination sequences. Vectors may also include, for example, origins of replication, scaffold attachment regions (SARs), markers, homologous sequences, and introns. The vector may also comprise a marker gene that confers a selectable phenotype on plant cells. The marker may encode a biocide resistance trait, particularly antibiotic resistance, such as resistance to, for example, kanamycin, bleomycin, or hygromycin, or herbicide resistance, such as resistance to, for example, glyphosate, chlorosulfuron or phosphinotricin.

It will be understood that more than one regulatory region may be present in a recombinant polynucleotide, e.g., introns, enhancers, upstream activation regions, transcription terminators, and inducible elements. Thus, more than one regulatory region can be operably linked to said sequence.

To "operably link" a promoter sequence to a sequence, the translation initiation site of the translational reading frame of said sequence is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene (Fromm et al., *The Plant Cell,* 1:977-984 (1989).

Some suitable promoters initiate transcription only, or predominantly, in certain cell types. For example, a promoter that is active predominantly in a reproductive tissue (e.g., fruit, ovule, pollen, pistils, female gametophyte, egg cell, central cell, nucellus, suspensor, synergid cell, flowers, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano, et al. (1989) *Plant Cell* 1:855-866; Bustos et al. (1989) *Plant Cell* 1:839-854; Green et al. (1988) *EMBO J.* 7: 4035-4044; Meier et al. (1991) *Plant Cell* 3: 309-316; and Zhang et al. (1996) *Plant Physiology* 110: 1069-1079.

Examples of various classes of promoters are described below. Some of the promoters indicated below are described in more detail in U.S. Patent Application Ser. Nos. 60/505, 689; 60/518,075; 60/544,771; 60/558,869; 60/583,691; 60/619,181; 60/637,140; 10/950,321; 10/957,569; 11/058, 689; 11/172,703; 11/208,308; and PCT/US05/23639. It will be appreciated that a promoter may meet criteria for one classification based on its activity in one plant species, and yet meet criteria for a different classification based on its activity in another plant species.

Other Regulatory Regions: A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

Various promoters can be used to drive expression of the polynucleotides of the present invention. Nucleotide sequences of such promoters are set forth in SEQ ID NOS: 1-94. Some of them can be broadly expressing promoters; others may be more tissue preferential.

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO:76), YP0144 (SEQ ID NO:55), YP0190 (SEQ ID NO:59), p13879 (SEQ ID NO:75), YP0050 (SEQ ID NO:35), p32449 (SEQ ID NO:77), 21876 (SEQ ID NO:1), YP0158 (SEQ ID NO:57), YP0214 (SEQ ID NO:61), YP0380 (SEQ ID NO:70), PT0848 (SEQ ID NO:26), and PT0633 (SEQ ID NO:7) promoters. Additional examples include the cauliflower mosaic virus (CaMV) 35S promoter, the mannopine synthase (MAS) promoter, the 1' or 2' promoters derived from T-DNA of *Agrobacterium tumefaciens,* the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128 (SEQ ID NO:52), YP0275 (SEQ ID NO:63), PT0625 (SEQ ID NO:6), PT0660 (SEQ ID NO:9), PT0683 (SEQ ID NO: 14), and PT0758 (SEQ ID NO:22) promoters. Other root-preferential promoters include the PT0613 (SEQ ID NO:5), PT0672 (SEQ ID NO:11), PT0688 (SEQ ID NO:15), and PT0837 (SEQ ID NO:24) promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA,* 86:7890-7894 (1989)), root cell specific promoters reported by Conkling et al., *Plant Physiol.,* 93:1203-1211 (1990), and the tobacco RD2 promoter.

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell,* 1(9):839-853 (1989)), the soybean trypsin inhibitor promoter (Riggs et al., *Plant Cell,* 1(6):609-621 (1989)), the ACP promoter (Baerson et al., *Plant Mol. Biol.,* 22(2):255-267 (1993)), the stearoyl-ACP desaturase promoter (Slocombe et al., *Plant Physiol.,* 104(4):167-176 (1994)), the soybean α' subunit of β-conglycinin promoter (Chen et al., *Proc. Natl. Acad. Sci. USA,* 83:8560-8564 (1986)), the oleosin promoter (Hong et al., *Plant Mol. Biol.,* 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.,* 13:5829-5842 (1993)), the beta-amylase promoter, and the barley hordein promoter. Other maturing endosperm promoters include the YP0092 (SEQ ID NO:38), PT0676 (SEQ ID NO:12), and PT0708 (SEQ ID NO:17) promoters.

Promoters that are active in ovary tissues such as the ovule wall and mesocarp can also be useful, e.g., a polygalacturonidase promoter, the banana TRX promoter, the melon actin promoter, YP0396 (SEQ ID NO:74), and PT0623 (SEQ ID NO:94). Examples of promoters that are active primarily in ovules include YP0007 (SEQ ID NO:30), YP0111 (SEQ ID NO:46), YP0092 (SEQ ID NO:38), YP1003 (SEQ ID NO:43), YP0028 (SEQ ID NO:33), YP0121 (SEQ ID NO:51), YP0008 (SEQ ID NO:31), YP0039 (SEQ ID NO:34), YP0115 (SEQ ID NO:47), YP0119 (SEQ ID NO:49), YP0120 (SEQ ID NO:50), and YP0374 (SEQ ID NO:68).

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039 (SEQ ID NO:34), YP0011 (SEQ ID NO:41), YP0102 (SEQ ID NO:42), YP0110 (SEQ ID NO:45), YP0117 (SEQ ID NO:48), YP0119 (SEQ ID NO:49), YP0137 (SEQ ID NO:53), DME, YP0285 (SEQ ID NO:64), and YP0212 (SEQ ID NO:60). Other promoters that may be useful include the following rice promoters: p530c10 (SEQ ID NO:100), pOsFIE2-2 (SEQ ID NO:101), pOsMEA (SEQ ID NO:102), pOsYp102 (SEQ ID NO:103) and pOsYp285 (SEQ ID NO:104).

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097 (SEQ ID NO:40), YP0107 (SEQ ID NO:44), YP0088 (SEQ ID NO:37), YP0143 (SEQ ID NO:54), YP0156 (SEQ ID NO:56), PT0650 (SEQ ID NO:8), PT0695 (SEQ ID NO:16), PT0723 (SEQ ID NO:19), PT0838 (SEQ ID NO:25), PT0879 (SEQ ID NO:28), and PT0740 (SEQ ID NO:20).

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (PbcS) promoters such as the PbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104: 997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psae, PC, FNR, atpC, atpD, cab, rbcS). Other photosynthetic tissue promoters include PT0535 (SEQ ID NO:3), PT0668 (SEQ ID NO:2), PT0886 (SEQ ID NO:29), YP0144 (SEQ ID NO:55), YP0380 (SEQ ID NO:70) and PT0585 (SEQ ID NO:4).

Examples of promoters that have high or preferential activity in vascular bundles include YP0087 (SEQ ID NO:86), YP0093 (SEQ ID NO:87), YP0108 (SEQ ID NO:88), YP0022 (SEQ ID NO:89), and YP0080 (SEQ ID NO:90). Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the Rice Tungro Bacilliform Virus (RTBV) promoter (Dai et al., *Proc. Natl. Acad. Sci. USA*, 101(2):687-692 (2004)).

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380 (SEQ ID NO:70), PT0848 (SEQ ID NO:26), YP0381 (SEQ ID NO:71), YP0337 (SEQ ID NO:66), PT0633 (SEQ ID NO:7), YP0374 (SEQ ID NO:68), PT0710 (SEQ ID NO:18), YP0356 (SEQ ID NO:67), YP0385 (SEQ ID NO:73), YP0396 (SEQ ID NO:74), YP0388 (SEQ ID NO:92), YP0384 (SEQ ID NO:72), PT0688 (SEQ ID NO:15), YP0286 (SEQ ID NO:65), YP0377 (SEQ ID NO:69), PD1367 (SEQ ID NO:78), and PD0901 (SEQ ID NO:93). Examples of nitrogen-inducible promoters include PT0863 (SEQ ID NO:27), PT0829 (SEQ ID NO:23), PT0665 (SEQ ID NO:10), and PT0886 (SEQ ID NO:29). Examples of shade-inducible promoters include PR0924 (SEQ ID NO:91) and PT0678 (SEQ ID NO:13).

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other classes of promoters include, but are not limited to, shoot-preferential, callus-preferential, trichome cell-preferential, guard cell-preferential such as PT0678 (SEQ ID NO: 13), tuber-preferential, parenchyma cell-preferential, and senescence-preferential promoters. Promoters designated YP0086 (SEQ ID NO:36), YP0188 (SEQ ID NO:58), YP0263 (SEQ ID NO:62), PT0758 (SEQ ID NO:22), PT0743 (SEQ ID NO:21), PT0829 (SEQ ID NO:23), YP0119 (SEQ ID NO:49), and YP0096 (SEQ ID NO:39), as described in the above-referenced patent applications, may also be useful.

A promoter can be said to be "broadly expressing" when it promotes transcription in many, but not necessarily all, plant tissues or plant cells. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO: 76), YP0144 (SEQ ID NO: 55), YP0190 (SEQ ID NO: 59), p13879 (SEQ ID NO: 75), YP0050 (SEQ ID NO: 35), p32449 (SEQ ID NO: 77), 21876 (SEQ ID NO: 1), YP0158 (SEQ ID NO: 57), YP0214 (SEQ ID NO: 61), YP0380 (SEQ ID NO: 70), PT0848 (SEQ ID NO: 26), and PT0633 (SEQ ID NO: 7). Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root-active promoters drive transcription in root tissue, e.g., root endodermis, root epidermis, or root vascular tissues. In some embodiments, root-active promoters are root-preferential promoters, i.e., drive transcription only or predominantly in root tissue. Root-preferential promoters include the YP0128 (SEQ ID NO: 52), YP0275 (SEQ ID NO: 63), PT0625 (SEQ ID NO: 6), PT0660 (SEQ ID NO: 9), PT0683 (SEQ ID NO: 14), and PT0758 (SEQ ID NO: 22). Other root-preferential promoters include the PT0613 (SEQ ID NO: 5), PT0672 (SEQ ID NO: 11), PT0688 (SEQ ID NO: 15), and PT0837 (SEQ ID NO: 24), which drive transcription primarily in root tissue and to a lesser extent in ovules and/or seeds. Other examples of root-preferential promoters include the root-specific subdomains of the CaMV 35S promoter (Lam et al. (1989) *Proc. Natl. Acad. Sci. USA* 86:7890-7894), root cell specific promoters reported by Conkling et al. (1990) *Plant Physiol.* 93:1203-1211 and the tobacco RD2 gene promoter.

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin gene promoter (Bustos et al. (1989) *Plant Cell* 1(9):839-853), the soybean trypsin inhibitor promoter (Riggs et al. (1989) *Plant Cell* 1(6):609-621), the ACP promoter (Baerson et al. (1993) *Plant Mol Biol,* 22(2):255-267), the stearoyl-ACP desaturase gene (Slocombe et al. (1994) *Plant Physiol* 104(4):167-176), the soybean α' subunit of β-conglycinin promoter (Chen et al. (1986) *Proc Natl Acad Sci USA* 83:8560-8564), the oleosin promoter (Hong et al. (1997) *Plant Mol Biol* 34(3):549-555), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al. (1993) *Mol. Cell. Biol.* 13:5829-5842), the beta-amylase gene promoter, and the barley hordein gene promoter. Other maturing endosperm promoters include the YP0092 (SEQ ID NO: 38), PT0676 (SEQ ID NO: 12), and PT0708 (SEQ ID NO: 17).

Promoters that drive transcription in ovary tissues such as the ovule wall and mesocarp can also be useful, e.g., a polygalacturonidase promoter, the banana TRX promoter, and the melon actin promoter. Other such promoters that drive gene expression preferentially in ovules are YP0007 (SEQ ID NO: 30), YP0111 (SEQ ID NO: 46), YP0092 (SEQ ID NO: 38), YP0103 (SEQ ID NO: 43), YP0028 (SEQ ID NO: 33), YP0121 (SEQ ID NO: 51), YP0008 (SEQ ID NO: 31), YP0039 (SEQ ID NO: 34), YP0115 (SEQ ID NO: 47), YP0119 (SEQ ID NO: 49), YP0120 (SEQ ID NO: 50) and YP0374 (SEQ ID NO: 68).

In some other embodiments of the present invention, embryo sac/early endosperm promoters can be used in order drive transcription of the sequence of interest in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see Urao (1996) *Plant Mol. Biol.,* 32:571-57; Conceicao (1994) *Plant,* 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics,* 142:1009-1020); maize Cat3 (see, GenBank No. L05934; Abler (1993) *Plant Mol. Biol.,* 22:10131-1038). Other promoters include the following *Arabidopsis* promoters: YP0039 (SEQ ID NO: 34), YP0101 (SEQ ID NO: 41), YP0102 (SEQ ID NO: 42), YP0110 (SEQ ID NO: 45), YP0117 (SEQ ID NO: 48), YP0119 (SEQ ID NO: 49), YP0137 (SEQ ID NO: 53), DME, YP0285 (SEQ ID NO: 64), and YP0212 (SEQ ID NO: 60). Other promoters that may be useful include the following rice promoters: p530c10, pOsFIE2-2, pOsMEA, pOsYp102, and pOsYp285.

Promoters that preferentially drive transcription in zygotic cells following fertilization can provide embryo-preferential expression and may be useful for the present invention. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654, YP0097 (SEQ ID NO: 40), YP0107 (SEQ ID NO: 44), YP0088 (SEQ ID NO: 37), YP0143 (SEQ ID NO: 54), YP0156 (SEQ ID NO: 56), PT0650 (SEQ ID NO: 8), PT0695 (SEQ ID NO: 16), PT0723 (SEQ ID NO: 19), PT0838 (SEQ ID NO: 25), PT0879 (SEQ ID NO: 28) and PT0740 (SEQ ID NO: 20).

Promoters active in photosynthetic tissue in order to drive transcription in green tissues such as leaves and stems are of particular interest for the present invention. Most suitable are promoters that drive expression only or predominantly such tissues. Examples of such promoters include the ribulose-1, 5-bisphosphate carboxylase (RbcS) promoters such as the RbcS promoter from eastern larch (*Larix laricina*), the pine cab6 promoter (Yamamoto et al. (1994) *Plant Cell Physiol.* 35:773-778), the Cab-1 gene promoter from wheat (Fejes et al. (1990) *Plant Mol. Biol.* 15:921-932), the CAB-1 promoter from spinach (Lubberstedt et al. (1994) *Plant Physiol.* 104: 997-1006), the cabIR promoter from rice (Luan et al. (1992) *Plant Cell* 4:971-981), the pyruvate orthophosphate dikinase (PPDK) promoter from corn (Matsuoka et al. (1993) *Proc Natl Acad. Sci. USA* 90:9586-9590), the tobacco Lhcb1*2 promoter (Cerdan et al. (1997) *Plant Mol. Biol.* 33:245-255), the *Arabidopsis thaliana* SUC2 sucrose-H+ symporter promoter (Truernit et al. (1995) *Planta* 196:564-570), and thylakoid membrane protein promoters from spinach (psaD, psaF, psaE, PC, FNR, atpC, atpD, cab, rbcS. Other promoters that drive transcription in stems, leafs and green tissue are PT0535 (SEQ ID NO: 3), PT0668 (SEQ ID NO: 2), PT0886 (SEQ ID NO: 29), PR0924 (SEQ ID NO: 78), YP0144 (SEQ ID NO: 55), YP0380 (SEQ ID NO: 70) and PT0585 (SEQ ID NO: 4).

In some other embodiments of the present invention, inducible promoters may be desired. Inducible promoters drive transcription in response to external stimuli such as chemical agents or environmental stimuli. For example, inducible promoters can confer transcription in response to hormones such as giberellic acid or ethylene, or in response to light or drought. Examples of drought inducible promoters are YP0380 (SEQ ID NO: 70), PT0848 (SEQ ID NO: 26), YP0381 (SEQ ID NO: 71), YP0337 (SEQ ID NO: 66), PT0633 (SEQ ID NO: 7), YP0374 (SEQ ID NO: 68), PT0710 (SEQ ID NO: 18), YP0356 (SEQ ID NO: 67), YP0385 (SEQ ID NO: 73), YP0396 (SEQ ID NO: 74), YP0384 (SEQ ID NO: 72), PT0688 (SEQ ID NO: 15), YP0286 (SEQ ID NO: 65), YP0377 (SEQ ID NO: 69), and PD1367 (SEQ ID NO: 78). Examples of promoters induced by nitrogen are PT0863 (SEQ ID NO: 27), PT0829 (SEQ ID NO: 23), PT0665 (SEQ ID NO: 10) and PT0886 (SEQ ID NO: 29). An example of a promoter induced by salt is rd29A (Kasuga et al. (1999) *Nature Biotech* 17: 287-291).

Other Promoters: Other classes of promoters include, but are not limited to, leaf-preferential, stem/shoot-preferential, callus-preferential, guard cell-preferential, such as PT0678 (SEQ ID NO: 13), and senescence-preferential promoters. Promoters designated YP0086 (SEQ ID NO: 36), YP0188 (SEQ ID NO: 58), YP0263 (SEQ ID NO: 62), PT0758 (SEQ ID NO: 22), PT0743 (SEQ ID NO: 21), PT0829 (SEQ ID NO: 23), YP0119 (SEQ ID NO: 49), and YP0096 (SEQ ID NO: 39), as described in the above-referenced patent applications, may also be useful.

Alternatively, misexpression can be accomplished using a two component system, whereby the first component consists of a transgenic plant comprising a transcriptional activator operatively linked to a promoter and the second component consists of a transgenic plant that comprise a nucleic acid molecule of the invention operatively linked to the target-binding sequence/region of the transcriptional activator. The two transgenic plants are crossed and the nucleic acid molecule of the invention is expressed in the progeny of the plant. In another alternative embodiment of the present invention, the misexpression can be accomplished by having the sequences of the two component system transformed in one transgenic plant line.

Another alternative consists in inhibiting expression of a growth or phenotype-modulating polypeptide in a plant species of interest. The term "expression" refers to the process of converting genetic information encoded in a polynucleotide into RNA through transcription of the polynucleotide (i.e., via the enzymatic action of an RNA polymerase), and into protein, through translation of mRNA. "Up-regulation" or "activation" refers to regulation that increases the production of expression products relative to basal or native states, while "down-regulation" or "repression" refers to regulation that decreases production relative to basal or native states.

Another alternative consists in inhibiting expression of a biomass or vigor-modulating polypeptide in a plant species of interest under saline conditions. The term "expression" refers to the process of converting genetic information encoded in a polynucleotide into RNA through transcription of the polynucleotide (i.e., via the enzymatic action of an RNA polymerase), and into protein through translation of mRNA. "Up-regulation" or "activation" refers to regulation that increases the production of expression products relative to basal or native states, while "down-regulation" or "repression" refers to regulation that decreases production relative to basal or native states.

A number of nucleic-acid based methods, including antisense RNA, ribozyme directed RNA cleavage, and interfering RNA (RNAi) can be used to inhibit protein expression in plants. Antisense technology is one well-known method. In this method, a nucleic acid segment from the endogenous gene is cloned and operably linked to a promoter so that the antisense strand of RNA is transcribed. The recombinant vector is then transformed into plants, as described above, and the antisense strand of RNA is produced. The nucleic acid segment need not be the entire sequence of the endogenous gene to be repressed, but typically will be substantially identical to at least a portion of the endogenous gene to be repressed. Generally, higher homology can be used to compensate for the use of a shorter sequence. Typically, a sequence of at least 30 nucleotides is used (e.g., at least 40, 50, 80, 100, 200, 500 nucleotides or more).

Thus, for example, an isolated nucleic acid provided herein can be an antisense nucleic acid to one of the aforementioned nucleic acids encoding a flowering-modulating polypeptide. A nucleic acid that decreases the level of a transcription or translation product of a gene encoding a growth or phenotype-modulating polypeptide is transcribed into an antisense nucleic acid similar or identical to the sense coding sequence of the growth or phenotype-modulating polypeptide. Alternatively, the transcription product of an isolated nucleic acid can be similar or identical to the sense coding sequence of a growth or phenotype-modulating polypeptide, but is an RNA that is unpolyadenylated, lacks a 5' cap structure, or contains an unsplicable intron.

In another method, a nucleic acid can be transcribed into a ribozyme, or catalytic RNA, that affects expression of an mRNA. (See, U.S. Pat. No. 6,423,885). Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo (53-54). RNA endoribonucleases such as the one that occurs naturally in *Tetrahymena thermophila*, and which have been described extensively by Cech and collaborators can be useful. See, for example, U.S. Pat. No. 4,987,071.

Methods based on RNA interference (RNAi) can be used. RNA interference is a cellular mechanism to regulate the expression of genes and the replication of viruses. This mechanism is thought to be mediated by double-stranded small interfering RNA molecules. A cell responds to such a double-stranded RNA by destroying endogenous mRNA having the same sequence as the double-stranded RNA. Methods for designing and preparing interfering RNAs are known to those of skill in the art; see, e.g., WO 99/32619 and WO 01/75164. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises an antisense sequence of the biomass-modulating polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. See, e.g., WO 99/53050.

Transcriptional silencing of the target gene can also be achieved via the promoter through expression of an RNAi construct. This results in the synthesis of double stranded RNA molecules of which the nucleotides sequence is identical to a part of the promoter region of the target gene.

Another alternative method for suppression of the target gene may be achieved through a methodology generally referred to as Virus Induced Gene Silencing or VIGS (Ratcliff et al (2001) Plant J. 25, 237-245). Here, effective and specific gene silencing is achieved by infection of a plant with a plant virus carrying an insert which is homologous to the target gene. The advantage of the VIGS system is that there is no need to develop a plant transformation protocol for the plant species in which the target gene resides.

In all of these silencing methods, the silencing construct (antisense RNA, co-suppression, RNAi or hairpin construct or VIGs vector) preferably contains a DNA fragment that is identical to the target sequence (gene or promoter) that needs to be silenced. The percentage of identity may, however, range between 50-100%, preferably between 60-100%, more preferably between 70-100%, even more preferably between 80-100% and most preferably between 90-100%.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained (for example, Summerton and Weller, 1997, *Antisense Nucleic Acid Drug Dev.*, 7:187-195; Hyrup et al., 1996, *Bioorgan. Med. Chem.*, 4:5-23.). In addition, the deoxyphosphate backbone can be replaced with, for example, a phosphorothioate or phosphorodithioate backbone, a phosphoroamidite, or an alkyl phosphotriester backbone.

Transformation

Nucleic acid molecules of the present invention may be introduced into the genome or the cell of the appropriate host plant by a variety of techniques. These techniques, able to transform a wide variety of higher plant species, are well known and described in the technical and scientific literature (Vissenberg et al. (2005) *Plant Cell Physiol* 46:192; Husebye et al. (2002) *Plant Physiol* 128:1180.).

A variety of techniques known in the art are available for the introduction of DNA into a plant host cell. These techniques include transformation of plant cells by injection (Plesch et al. (2001) *Plant J* 28:455), microinjection (Griesbach (1987) *Plant Sci.* 50:69-77), electroporation of DNA (Fromm et al. (1985) *Proc. Natl. Acad. Sci. USA* 82:5824), PEG (Paszkowski et al. (1984) *EMBO J.* 3:2717), use of biolistics (Klein et al. (1987) *Nature* 327:773), fusion of cells or protoplasts (Willmitzer, L. (1993) Transgenic Plants. In: iotechnology, A Multi-Volume Comprehensive treatise (H. J. Rehm, G. Reed, A. Püler, P. Stadler, eds., Vol. 2, 627-659, VCH Weinheim-New York-Basel-Cambridge)), and via T-DNA using *Agrobacterium tumefaciens* (*Crit. Rev. Plant. Sci.* 4:1-46; Fromm et al. (1990) *Biotechnology* 8:833-844) or *Agrobacterium rhizogenes* (Cho et al. (2000) *Planta* 210:195-204) or other bacterial hosts (Brootghaerts et al. (2005) *Nature* 433:629-633), for example.

In addition, a number of non-stable transformation methods that are well known to those skilled in the art may be desirable for the present invention. Such methods include, but are not limited to, transient expression (Lincoln et al. (1998) *Plant Mol. Biol. Rep.* 16:1-4) and viral transfection (Lacomme et al. (2001), "Genetically Engineered Viruses" (C. J. A. Ring and E. D. Blair, Eds). Pp. 59-99, BIOS Scientific Publishers, Ltd. Oxford, UK).

Seeds are obtained from the transformed plants and used for testing stability and inheritance. Generally, two or more generations are cultivated to ensure that the phenotypic feature is stably maintained and transmitted.

A person of ordinary skill in the art recognizes that after the expression cassette is stably incorporated in transgenic plants and confirmed to be operable, it can be introduced into other plants by sexual crossing. Any of a number of standard breeding techniques can be used, depending upon the species to be crossed.

In aspects related to making transgenic plants, a typical step involves selection or screening of transformed plants, e.g., for the presence of a functional vector as evidenced by expression of a selectable marker. Selection or screening can be carried out among a population of recipient cells to identify transformants using selectable marker genes such as herbicide resistance genes. Physical and biochemical methods can be used to identify transformants. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

A population of transgenic plants can be screened and/or selected for those members of the population that have a desired trait or phenotype conferred by expression of the transgene. For example, a population of progeny of a single transformation event can be screened for those plants having a desired level of expression of a heterologous salt tolerance polypeptide or nucleic acid. As an alternative, a population of plants comprising independent transformation events can be screened for those plants having a desired trait, such as salt tolerance. Selection and/or screening can be carried out over one or more generations, which can be useful to identify those plants that have a statistically significant difference in a protein level as compared to a corresponding level in a control plant. Selection and/or screening can also be carried out in more than one geographic location. In some cases, transgenic plants can be grown and selected under conditions which induce a desired phenotype or are otherwise necessary to produce a desired phenotype in a transgenic plant. In addition, selection and/or screening can be carried out during a particular developmental stage in which the phenotype is expected to be exhibited by the plant. Selection and/or screening can be carried out to choose those transgenic plants having a statistically significant difference in salt tolerance relative to a control plant that lacks the transgene. Selected or screened transgenic plants have an altered phenotype as compared to a corresponding control plant, as described elsewhere in this specification.

Transgenic Plant Phenotypes

Information that the polypeptides disclosed herein can modulate flowering are useful in breeding of crop plants. Based on the effect of the disclosed polypeptides on the timing of flowering, one can search for and identify polymorphisms linked to genetic loci for such polypeptides. Polymorphisms that can be identified include simple sequence repeats (SSRs), amplified fragment length polymorphisms (AFLPs) and restriction fragment length polymorphisms (RFLPs).

If a polymorphism is identified, its presence and frequency in populations is analyzed to determine if it is statistically significantly correlated to an alteration in timing of flowering. Those polymorphisms that are correlated with an alteration in timing of flowering can be incorporated into a marker assisted breeding program to facilitate the development of lines that have a desired alteration in the timing of flowering. Typically, a polymorphism identified in such a manner is used with polymorphisms at other loci that are also correlated with a desired alteration in timing of flowering or other desired trait.

The methods according to the present invention can be applied to any plant, such as, for example, higher plants, pertaining to the classes of Angiospermae and Gymnospermae. Plants of the subclasses of the Dicotylodenae and the Monocotyledonae are also suitable. Dicotyledonous plants belonging to the orders of the Magniolales, Illiciales, Laurales, Piperales Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, Santales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales, for example, are also suitable. Monocotyledonous plants belonging to the orders of the Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchidales also may be useful in embodiments of the present invention. Further examples include, but are not limited to, plants belonging to the class of the Gymnospermae are Pinales, Ginkgoales, Cycadales and Gnetales.

The methods of the present invention are preferably used in plants that are important or interesting for agriculture, horticulture, biomass for bioconversion and/or forestry. Non-limiting examples include, for instance, tobacco, oilseed rape, sugar beet, potatoes, tomatoes, cucumbers, peppers, beans, peas, citrus fruits, avocados, peaches, apples, pears, berries, plumbs, melons, eggplants, cotton, soybean, sunflowers, roses, poinsettia, petunia, guayule, cabbages, spinach, alfalfa, artichokes, sugarcane, mimosa, *Servicea lespedera*, corn, wheat, rice, rye, barley, sorghum and grasses such as switch grass, giant reed, Bermuda grass, Johnson grasses or turf grass, millet, hemp, bananas, poplars, eucalyptus trees and conifers. Of interest are plants grown for energy production, so called energy crops, such as broadleaf plants like alfalfa, hemp, Jerusalem artichoke and grasses such as sorghum, switchgrass, Johnson grass and the likes. Thus, the described materials and methods are useful for modifying biomass characteristics, such as characteristics of biomass renewable energy source plants. A biomass renewable energy source plant is a plant having or producing material (either raw or processed) that comprises stored solar energy that can be converted to fuel. In general terms, such plants comprise dedicated energy crops as well as agricultural and woody plants. Examples of biomass renewable energy source plants include: switchgrass, elephant grass, giant chinese silver grass, energycane, giant reed (also known as wild cane), tall fescue, bermuda grass, sorghum, napier grass, also known as uganda grass, triticale, rye, winter wheat, shrub poplar, shrub willow, big bluestem, reed canary grass and corn.

Homologues Encompassed by the Invention

It is known in the art that one or more amino acids in a sequence can be substituted with other amino acid(s), the charge and polarity of which are similar to that of the substituted amino acid, i.e. a conservative amino acid substitution, resulting in a biologically/functionally silent change. Conservative substitutes for an amino acid within the polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as serine, threonine, tyrosine, asparagine, and glutamine; and (4) neutral nonpolar (hydrophobic) amino acids such as glycine, alanine, leucine, isoleucine, valine, proline, phenylalanine, tryptophan, cysteine, and methionine.

Nucleic acid molecules of the present invention can comprise sequences that differ from those encoding a protein or fragment thereof selected from the group consisting of the nucleotide sequences in the sequence listing due to the fact that the different nucleic acid sequence encodes a protein having one or more conservative amino acid changes.

Biologically functional equivalents of the polypeptides, or fragments thereof, of the present invention can have about 10 or fewer conservative amino acid changes, alternatively about 7 or fewer conservative amino acid changes, and alternatively about 5 or fewer conservative amino acid changes. In another embodiment of the present invention, the polypeptide has between about 5 and about 500 conservative changes, alternatively between about 10 and about 300 conservative changes, and alternatively between about 25 and about 150 conservative changes, and alternatively between about 5 and about 25 conservative changes or between 1 and about 5 conservative changes.

Identification of Useful Nucleic Acid Molecules and Their Corresponding Nucleotide Sequences The nucleic acid molecules, and nucleotide sequences thereof, of the present invention were identified by use of a variety of screens that are predictive of nucleotide sequences that provide plants with altered flowering times. One or more of the following screens were, therefore, utilized to identify the nucleotide (and amino acid) sequences of the present invention.

The present invention is further exemplified by the following examples. The examples are not intended to in any way limit the scope of the present application and its uses.

6. Experiments Confirming the Usefulness of the Polynucleotides and Polypeptides of the Invention General Protocols

*Agrobacterium*-Mediated Transformation of *Arabidopsis*

Host Plants and Transgenes: Wild-type *Arahidopsis thaliana Wassilewskija* (WS) plants are transformed with Ti plasmids containing nucleic acid sequences to be expressed, as noted in the respective examples, in the sense orientation relative to the 35S promoter in a Ti plasmid. A Ti plasmid vector useful for these constructs, CRS 338, contains the Ceres-constructed, plant selectable marker gene phosphinothricin acetyltransferase (PAT), which confers herbicide resistance to transformed plants.

Ten independently transformed events are typically selected and evaluated for their qualitative phenotype in the $T_1$ generation.

Preparation of Soil Mixture: 24 L Sunshine Mix #5 soil (Sun Gro Horticulture, Ltd., Bellevue, Wash.) is mixed with 16 L Therm-O-Rock vermiculite (Therm-O-Rock West, Inc., Chandler, Ariz.) in a cement mixer to make a 60:40 soil mixture. To the soil mixture is added 2 Tbsp Marathon 1% granules (Hummert, Earth City, Mo.), 3 Tbsp OSMOCOTE® 14-14-14 (Hummert, Earth City, Mo.) and 1 Tbsp Peters fertilizer 20-20-20 (J. R. Peters, Inc., Allentown, Pa.), which are first added to 3 gallons of water and then added to the soil and mixed thoroughly. Generally, 4-inch diameter pots are filled with soil mixture. Pots are then covered with 8-inch squares of nylon netting.

Planting: Using a 60 mL syringe, 35 mL of the seed mixture is aspirated. 25 drops are added to each pot. Clear propagation domes are placed on top of the pots that are then placed under 55% shade cloth and subirrigated by adding 1 inch of water.

Plant Maintenance: 3 to 4 days after planting, lids and shade cloth are removed. Plants are watered as needed. After 7-10 days, pots are thinned to 20 plants per pot using forceps. After 2 weeks, all plants are subirrigated with Peters fertilizer at a rate of 1 Tsp per gallon of water. When bolts are about 5-10 cm long, they are clipped between the first node and the base of stem to induce secondary bolts. Dipping infiltration is performed 6 to 7 days after clipping.

Preparation of *Agrobacterium*: To 150 mL fresh YEB is added 0.1 mL each of carbenicillin, spectinomycin and rifampicin (each at 100 mg/ml stock concentration). *Agrobacterium* starter blocks are obtained (96-well block with *Agrobacterium* cultures grown to an $OD_{600}$ of approximately 1.0) and inoculated one culture vessel per construct by transferring 1 mL from appropriate well in the starter block. Cultures are then incubated with shaking at 27° C. Cultures are spun down after attaining an $OD_{600}$ of approximately 1.0 (about 24 hours). 200 mL infiltration media is added to resuspend *Agrobacterium* pellets. Infiltration media is prepared by adding 2.2 g MS salts, 50 g sucrose, and 5 μL 2 mg/mil benzylaminopurine to 900 ml water.

Dipping Infiltration: The pots are inverted and submerged for 5 minutes so that the aerial portion of the plant is in the *Agrobacterium* suspension. Plants are allowed to grow normally and seed is collected.

High-throughput Phenotypic Screening of Misexpression Mutants: Seed is evenly dispersed into water-saturated soil in pots and placed into a dark 4° C. cooler for two nights to promote uniform germination. Pots are then removed from the cooler and covered with 55% shade cloth for 4-5 days. Cotyledons are fully expanded at this stage. FINALE® (Sanofi Aventis, Paris, France) is sprayed on plants (3 ml FINALE® diluted into 48 oz. water) and repeated every 3-4 days until only transformants remain.

Phenotyping: Phenotyping is routinely performed at four stages: seedling, rosette, flowering and senescence.

Seedling: the time after the cotyledons have emerged, but before the $3^{rd}$ true leaf begins to form.

Rosette—the time from the emergence of the $3^{rd}$ true leaf through just before the primary bolt begins to elongate.

Flowering—the time from the emergence of the primary bolt to the onset of senescence (with the exception of noting the flowering time itself, most observations should be made at the stage where approximately 50% of the flowers have opened).

Senescence—the time following the onset of senescence (with the exception of "delayed senescence", most observations should be made after the plant has completely dried). Seeds are then collected.

Validation: The early flowering validation was conducted in all experiments. The validation assays are implemented as follows.

Flowering time analyses are performed using at least two $T_2$ or $T_3$ events. Subsequently, the next generation ($T_3$ or $T_4$) seeds for the two events are evaluated under the same conditions. Briefly, soil is prepared as in the early flowering screen protocol. Soil in pots is subirrigated with water prior to adding seed. Five seeds are sown per pot. 24 pots are placed in a flat and covered with a clear plastic humidity dome. Flats are transferred to the dark at 4° C. for 3 days, then transferred to a growth chamber set at a 16:8 hour light:dark cycle or a 12:12 hour light:dark cycle, 150 μEinsteins, 70% relative humidity and 22° C.

After 5 days or when cotyledons are fully expanded, humidity domes are removed. On the $7^{th}$ day seedlings are weeded such that only one seedling remains in each pot. In this assay the time of bolting is used to measure the flowering time. The "days to bolting" is the number of days post-sowing that are required for the inflorescence of the plant to reach 1 cm in height. The number of rosette leaves is also counted at this stage.

Five days post-bolting Finale™ resistant:sensitive analysis is conducted by harvesting a portion of a cauline leaf from each plant including the control. The leaf sections are placed on petrie plates containing the following media: 2.165 g/L MS salts, 0.5 g/L MES Hydrate, 7 g/L PhytoTech Agar and 200 µl/L filter sterilized Finale™. Plates are incubated for two days in a growth chamber set at a 16:8 hour light:dark cycle or a 12:12 hour light:dark cycle, 150 teinsteins, 70% relative humidity and 22° C. Plates are analyzed using a CF Fluorescent Imager. Transgenic plants (Finale™ resistant) appear red while non-transgenic plants (Finale™ sensitive) appear blue.

The days to bolting of the transgenic plants within an event in one generation was compared with that of non-transgenic segregants pooled across all events in the same experiment. A t-test is used to determine whether the events flower significantly earlier than wild-type Ws at p=0.05 assuming one-tailed distribution and unequal variance.

Determining Transgene Copy Number: $T_2$ generation transformed plants are tested on BASTA™ plates in order to determine the transgene copy number of each transformed line. A BASTA™ resistant:BASTA™ sensitive segregation ratio of 3:1 generally indicates one copy of the transgene.

7. Results

MADS-box Proteins

MADS-box genes encode a family of transcriptional regulators that have been found in fungi, yeast, plants and animals. Members in this protein family contain a highly conserved ~60 amino acid DNA-binding MADS domain. MADS-box proteins play pivotal roles in diverse biological processes in various organisms. In plants, MADS-box proteins are demonstrated to be involved in a number of developmental processes, such as flowering time, floral meristem identity, floral organogenesis and fruit formation (Parenicova et al. (2003) Plant Cell 15:1538-1551)

AP2 Domain Proteins

The AP2 domain is a DNA-binding motif of about 60 amino acid residues that is present in numerous proteins in plants. AP2 domain-containing proteins are involved in a wide range of biological functions such as flower and seed development (Jofuku et al. 1994), ethylene response (Ohme-Takagi and Shinshi 1995), temperature and dehydration response (Stockinger et al 1997) and cell expansion and differentiation (Wilson et al 1996).

Dof Domain Proteins

Dof (DNA-binding with one finger) domain polyupeptides are plant-specific transcription factor polypeptides with a highly conserved DNA-binding domain. The D of domain consists of 52 amino acid residues that shows sequence resemblance to the Cys2/Cys2 zinc finger domain in GATA1-type transcription factors, although it has a longer putative loop where an extra Cys residue is conserved (Umemura et al. (2004) Plant J. 37: 741-749).

Casein Kinase II Beta Chain Proteins

The casein kinase II (CK2) beta chain is a highly conserved subunit of casein kinase II, a ubiquitous, well-conserved serine/threonine protein kinase involved in cell metabolism and differentiation. Casein kinase II forms a heterotetrameric structure in vivo consisting of two catalytic alpha subunits and two regulatory beta subunits. The CK2 beta chain possesses an N-terminal auto-phosphorylation site, an internal acidic domain and a potential metal-binding motif. The beta subunit is a highly conserved protein of about 25 kD that contains, in its central section, a cysteine-rich motif that could be involved in binding a metal such as zinc. It has been shown that CK2 can modulate transcription factors that regulate light-responsive genes in plants (Sugano et al. (1998) Proc Natl Acad Sci USA 95: 11020-11025).

WD-40 Repeat Family Protein

WD-40 repeats are short, ~40 amino acid motifs, often terminating in a Trp-Asp (W-D) dipeptide. WD-40-containing proteins usually have 4 to 16 repeating units, all of which are thought to form a circularized beta-propeller structure. WD-repeat proteins form a large family found in all eukaryotes and are implicated in a variety of functions ranging from signal transduction and transcription regulation to cell cycle control and apoptosis. An example is the pleiotropic developmental regulator LEUNING (LUG). LUG contains seven carboxyl-terminal WD motif repeats, internal polyglutamine tracts and an extended motif termed the single-stranded DNA-binding-protein. It has been shown that LUG functions in floral development together with SEUSS (SEU) (see Neer et al. (1994) Nature 371: 297-300).

60S Ribosomal Protein L21

Ribosomes are the particles in cells where mRNA-directed protein synthesis occurs in all organisms. L21 is one of the many subunits in ribosomes. It has been known that many of the proteins in the ribosome have other functions in addition to their roles in the ribosome (Crouzet and Begueret (1980) Mol Gen Genet. 180: 177-83).

Cyclin Family Proteins

Cyclins are key activators of cyclin-dependent Ser/Thr protein kinases, which play an essential role in controlling cell cycle progression in eukaryotes. In *Arabidopsis*, the cyclin family is comprised of over 50 genes. Overexpression of different cyclins has been demonstrated to enhance growth and development in plants. Cyclin may also play a role in the promoteion of cell division by the hormone cytokinin (Wnag et al (2004) Plant Physiol 135: 1084-1099).

PHD Finger Proteins

PHD finger proteins contain a PHD finger domain. This motif is similar to a C4HC3-type zinc finger motif and is often found in nuclear proteins which are thought to be involved in regulating gene transcription via chromatin remodeling. The PHD finger may act as a protein interaction domain although it is unclear whether PHD finger proteins have a common molecular function. In *Arabidopsis*, VIN3, a PHD-containing protein, functions as a suppressor of FLC (a negative regulator of flowering) in the vernalization pathway (Sung and Amasino, 2004).

Example 1

ME08427 (SEQ ID NO: 95)

The maize clone 241419 transformed in ME08427 encodes a MADS-box protein. An alignment of sequences showing similarity to the protein encoded by clone 241491 is presented in FIG. 1. A 16:8 hour light:dark regime was employed in the early flowering validation assay. Two events were chosen to be analyzed in both the $T_2$ and the $T_3$ generations. Data showing early flowering and number of rosette leaves at bolting are presented in Tables 1-1 and 1-2. The transgenic plants showed a slight decrease in average rosette diameter compared to the wild-type control, which is possibly caused by a reduced number of rosette leaves, and a slight curly-leaf phenotype.

TABLE 1-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | n | Days to Bolting | SE | n | p-value |
| ME08427 | ME08427-03 | T2 | 15.70 | 0.21 | 18 | 16.90 | 0.23 | 16 | 3.33E−04 |
| | | T3 | 15.80 | 0.31 | 15 | 17.60 | 0.22 | 20 | 2.23E−05 |
| | ME08427-05 | T2 | 15.90 | 0.24 | 14 | 16.90 | 0.23 | 16 | 3.86E−03 |
| | | T3 | 15.10 | 0.25 | 13 | 17.60 | 0.22 | 20 | 5.07E−09 |

TABLE 1-2

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME08427 | ME08427-03 | T2 | 5.72 | 0.13 | 18 | 6.63 | 0.13 | 16 | 1.33E−05 |
| | | T3 | 4.93 | 0.27 | 15 | 5.90 | 0.10 | 20 | 9.03E−04 |
| | ME08427-05 | T2 | 5.79 | 0.19 | 14 | 6.63 | 0.13 | 16 | 4.28E−04 |
| | | T3 | 4.46 | 0.24 | 13 | 5.90 | 0.10 | 20 | 2.80E−06 |

Example 2

ME03153 (SEQ ID NO:139)

The maize clone 246416 transformed in ME03153 encodes a MADS-box protein. An alignment of sequences showing similarity to the protein encoded by clone 246416 is presented in FIG. 2. A 16:8 hour light:dark regime was employed in the early flowering validation assay. Two events were chosen to be analyzed in both the $T_2$ and $T_3$ generations. Data showing early flowering are presented in Tables 2-1 and 2-2. The transgenic plants showed a slight decrease in average rosette diameter compared to the wild-type control, which is possibly caused by reduced number of rosette leaves, and a slight curly-leaf phenotype.

TABLE 2-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | n | Days to Bolting | SE | n | p-value |
| ME03153 | ME03153-01 | T2 | 15.20 | 0.32 | 14 | 16.80 | 0.26 | 21 | 3.59E−04 |
| | | T3 | 14.40 | 0.16 | 18 | 15.30 | 0.41 | 6 | 2.42E−02 |
| | ME03153-02 | T2 | 15.00 | 0.22 | 13 | 16.80 | 0.26 | 21 | 8.85E−06 |
| | | T3 | 14.30 | 0.18 | 24 | 15.30 | 0.41 | 6 | 1.33E−02 |

TABLE 2-2

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME03153 | ME03153-01 | T2 | 5.57 | 0.17 | 14 | 6.43 | 0.20 | 21 | 1.42E−03 |
| | | T3 | 4.33 | 0.18 | 18 | 4.67 | 0.42 | 6 | 2.38E−01 |
| | ME03153-02 | T2 | 5.15 | 0.19 | 13 | 6.43 | 0.20 | 21 | 3.31E−05 |
| | | T3 | 4.08 | 0.08 | 24 | 4.67 | 0.42 | 6 | 9.28E−02 |

Example 3

ME04928 (SEQ ID NO: 195)

The *Arabidopsis* clone 1010174 transformed in ME04928 encodes a MADS-F box protein (AGL11). An alignment of sequences showing similarity to the protein encoded by clone 1010174 is presented in FIG. 3. A 16:8 hour light:dark regime was employed in the early flowering validation assay. Two events were chosen to be analyzed in both the $T_3$ and the $T_4$ generations. Data showing early flowering and number of rosette leaves at bolting are presented in Tables 3-1 and 3-2. The plants displayed a slight curly-leaf phenotype.

The *Arabidopsis* plants transformed with the maize clone 228787 and the *Arabidopsis* clone 32791 that have sequence homology to the clone 1010174 also showed early flowering. The transgenic plants are significantly smaller than the ME04928 transgenic plants.

TABLE 3-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | n | Days to Bolting | SE | n | p-value |
| ME04928 | ME04928-02 | T3 | 16.10 | 0.15 | 21 | 17.90 | 0.14 | 49 | 4.43E−13 |
| | | T4 | 15.68 | 0.11 | 46 | 17.33 | 0.31 | 6 | 3.08E−06 |
| | ME04928-03 | T3 | 17.00 | 0.26 | 16 | 17.90 | 0.14 | 49 | 1.58E−03 |
| | | T4 | 16.15 | 0.09 | 41 | 17.33 | 0.31 | 6 | 2.80E−04 |

TABLE 3-2

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME04928 | ME04928-02 | T3 | 5.86 | 0.34 | 7 | 6.14 | 0.13 | 28 | 2.20E−01 |
| | | T4 | 5.70 | 0.07 | 46 | 6 | 0.00 | 6 | 2.51E−05 |
| | ME04928-03 | T3 | 5.62 | 0.18 | 13 | 6.14 | 0.13 | 28 | 1.19E−02 |
| | | T4 | 5.93 | 0.05 | 41 | 6 | 0.00 | 6 | 9.10E−02 |

Example 4

ME04522 (SEQ ID NO:237)

The *Arabidopsis* clone 22339 transformed in ME04522 encodes a MADS-box K protein (AGL1, SHATTERPROOF1). An alignment of sequences showing similarity to the protein encoded by clone 22339 is presented in FIG. 4. A 16:8 hour light:dark regime was employed in the early flowering validation assay. Two events were chosen to be analyzed in both the $T_2$ and the $T_3$ generations. Data showing early flowering and number of rosette leaves at bolting are presented in Tables 4-1 and 4-2. Event -05 was noted having slightly shorter siliques than the control.

The *Arabidopsis* plants transformed with the maize clone 243227 that has sequence homology to the clone 22339 also showed early flowering. The transgenic plants are significantly smaller than the ME04522 transgenic plants

TABLE 4-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | n | Days to Bolting | SE | n | p-value |
| ME04522 | ME04522-02 | T2 | 18.13 | 0.15 | 20 | 18.94 | 0.26 | 18 | 5.22E−03 |
| | | T3 | 16.24 | 0.19 | 21 | 17.92 | 0.23 | 26 | 7.70E−07 |
| | ME04522-05 | T2 | 17.79 | 0.20 | 21 | 18.94 | 0.26 | 18 | 6.15E−04 |
| | | T3 | 17.05 | 0.29 | 19 | 17.92 | 0.23 | 26 | 1.23E−02 |

TABLE 4-2

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME04522 | ME04522-02 | T2 | 5.80 | 0.16 | 20 | 6.67 | 0.14 | 18 | 9.99E−05 |
| | | T3 | 5.62 | 0.13 | 21 | 6.31 | 0.14 | 26 | 4.42E−04 |
| | ME04522-05 | T2 | 6.19 | 0.15 | 21 | 6.67 | 0.14 | 18 | 1.25E−02 |
| | | T3 | 5.84 | 0.19 | 19 | 6.31 | 0.14 | 26 | 2.93E−02 |

Example 5

ME07393 (SEQ ID NO:284)

The *Arabidopsis* clone 13660 transformed in ME07393 encodes a protein with unknown function. An alignment of sequences showing similarity to the protein encoded by clone 13660 is presented in FIG. 5. A 12:12 hour light:dark regime was employed in the early flowering validation assay. Two events were chosen to be analyzed in both the $T_2$ and the $T_3$ generations. Data showing early flowering and number of rosette leaves at bolting are presented in Tables 5-1 and 5-2. The transgenic plants showed a slight decrease in average rosette diameter compared to the wild-type control, which is possibly caused by reduced number of rosette leaves.

Example 6

ME03198 (SEQ ID NO: 298)

The soybean clone 708396 transformed in ME03198 encodes an AP2 domain-containing protein. An alignment of sequences showing similarity to the protein encoded by clone 708396 is presented in FIG. 6. A 16:8 hour light:dark regime was employed in the early flowering validation assay. Three events were chosen to be analyzed in both the $T_2$ and the $T_3$ generations. Data showing early flowering and number of rosette leaves at bolting are presented in Tables 6-1 and 6-2. The transgenic plants showed a slight decrease in average rosette diameter compared to the wild-type control, which is possibly caused by reduced number of rosette leaves.

TABLE 5-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | n | Days to Bolting | SE | n | p-value |
| ME07393 | ME07393-03 | T2 | 26.29 | 0.20 | 21 | 27.71 | 0.47 | 7 | 4.94E−03 |
| | | T3 | 24.38 | 0.31 | 16 | 27.71 | 0.47 | 7 | 3.96E−06 |
| | ME07393-04 | T2 | 21.93 | 0.38 | 15 | 23.17 | 0.47 | 12 | 2.70E−02 |
| | | T3 | 20.59 | 0.21 | 17 | 23.17 | 0.47 | 12 | 1.66E−05 |

TABLE 5-2

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME07393 | ME07393-03 | T2 | 10.10 | 0.18 | 21 | 11.43 | 0.48 | 7 | 7.69E−03 |
| | | T3 | 8.81 | 0.25 | 16 | 11.43 | 0.48 | 7 | 4.32E−05 |
| | ME07393-04 | T2 | 7.47 | 0.27 | 15 | 8.33 | 0.45 | 12 | 5.60E−02 |
| | | T3 | 6.88 | 0.15 | 17 | 8.33 | 0.45 | 12 | 2.41E−03 |

TABLE 6-1

T-test comparison of the days to bolting between transgenic plants and pooled non-transgenic segregants.

| Line | Events | Generation | Transgenic Days to Bolting | SE | n | Non-transgenic Days to Bolting | SE | n | p-value |
|---|---|---|---|---|---|---|---|---|---|
| ME03198 | ME03198-01 | T2 | 16.84 | 0.14 | 19 | 17.82 | 0.15 | 17 | 1.86E−05 |
| | | T3 | 16.67 | 0.15 | 21 | 17.99 | 0.13 | 41 | 5.79E−09 |
| | ME03198-03 | T2 | 17.90 | 0.21 | 21 | 19.17 | 0.32 | 12 | 1.20E−03 |
| | | T3 | 17.23 | 0.12 | 20 | 17.99 | 0.13 | 41 | 4.82E−05 |
| | ME03198-04 | T2 | 17.27 | 0.19 | 11 | 17.82 | 0.15 | 17 | 1.78E−02 |
| | | T3 | 16.10 | 0.16 | 21 | 17.99 | 0.13 | 41 | 4.30E−13 |

TABLE 6-2

T-test comparison of the number of rosette leaves at bolting between transgenic plants and pooled non-transgenic segregants.

| Line | Event | Generation | Transgenic Number of Rosette Leaves | SE | n | Non-transgenic Number of Rosette Leaves | SE | n | p-value |
|---|---|---|---|---|---|---|---|---|---|
| ME03198 | ME03198-01 | T2 | 5.21 | 0.12 | 19 | 6.35 | 0.15 | 17 | 4.81E−07 |
| | | T3 | 6.05 | 0.05 | 21 | 6.93 | 0.12 | 41 | 1.73E−09 |
| | ME03198-03 | T2 | 6.33 | 0.13 | 21 | 7.33 | 0.28 | 12 | 1.52E−03 |
| | | T3 | 6.15 | 0.08 | 20 | 6.93 | 0.12 | 41 | 5.96E−07 |
| | ME03198-04 | T2 | 5.45 | 0.16 | 11 | 6.35 | 0.15 | 17 | 1.50E−04 |
| | | T3 | 5.10 | 0.17 | 21 | 6.93 | 0.12 | 41 | 6.32E−13 |

Example 7

ME11030 (SEQ ID NO:326)

The *Arabidopsis* genomic clone At1g21340 transformed in ME11030 encodes a Dof-type zinc finger domain-containing protein. An alignment of sequences showing similarity to the protein encoded by clone At1g21340 is presented in FIG. 7. A 16:8 hour light:dark regime was employed in the early flowering validation assay. Three events were chosen to be analyzed in both the $T_2$ and the $T_3$ generations. Data showing early flowering and number of rosette leaves at bolting are presented in Tables 7-1 and 7-2. The transgenic plants showed a slight decrease in average rosette diameter compared to the wild-type control, which is possibly caused by reduced number of rosette leaves.

TABLE 7-1

T-test comparison of the days to bolting between transgenic plants and pooled non-transgenic segregants.

| Line | Events | Generation | Transgenic Days to Bolting | SE | n | Non-transgenic Days to Bolting | SE | n | p-value |
|---|---|---|---|---|---|---|---|---|---|
| ME11030 | ME11030-01 | T2 | 17.71 | 0.23 | 17 | 18.83 | 0.26 | 18 | 1.32E−03 |
| | | T3 | 17.10 | 0.12 | 20 | 18.30 | 0.11 | 53 | 6.79E−11 |
| | ME11030-02 | T2 | 17.32 | 0.20 | 22 | 18.83 | 0.26 | 18 | 2.59E−05 |
| | | T3 | 17.89 | 0.11 | 19 | 18.30 | 0.11 | 53 | 5.44E−03 |
| | ME11030-03 | T2 | 16.92 | 0.14 | 13 | 18.24 | 0.23 | 21 | 1.16E−05 |
| | | T3 | 17.66 | 0.13 | 16 | 18.30 | 0.11 | 53 | 1.22E−04 |

TABLE 7-2

T-test comparison of the number of rosette leaves at bolting between transgenic plants and pooled non-transgenic segregants.

| Line | Event | Generation | Transgenic Number of Rosette Leaves | SE | n | Non-transgenic Number of Rosette Leaves | SE | n | p-value |
|---|---|---|---|---|---|---|---|---|---|
| ME11030 | ME11030-01 | T2 | 6.18 | 0.18 | 17 | 6.94 | 0.10 | 18 | 2.93E−04 |
|  |  | T3 | 6.15 | 0.13 | 20 | 7.28 | 0.09 | 53 | 2.53E−10 |
|  | ME11030-02 | T2 | 6.00 | 0.13 | 22 | 6.94 | 0.10 | 18 | 6.19E−07 |
|  |  | T3 | 6.63 | 0.14 | 19 | 7.28 | 0.09 | 53 | 7.33E−05 |
|  | ME11030-03 | T2 | 4.93 | 0.13 | 14 | 5.76 | 0.19 | 21 | 5.22E−04 |
|  |  | T3 | 6.75 | 0.17 | 16 | 7.28 | 0.09 | 53 | 3.50E−03 |

Example 8

ME09573 (SEQ ID NO:341)

The *Arabidopsis* genomic clone At2g44680 transformed in ME11030 encodes a casein kinase II beta chain. An alignment of sequences showing similarity to the protein encoded by clone At2g44680 is presented in FIG. 8. A 12:12 hour light:dark regime was employed in the early flowering validation assay. Two events were chosen to be analyzed in the $T_2$ and the $T_3$ or $T_4$ generations. Data showing early flowering and number of rosette leaves at bolting are presented in Tables 8-1 and 8-2. The transgenic plants showed a slight decrease in average rosette diameter compared to the wild-type control, which is possibly caused by reduced number of rosette leaves.

Example 9

ME05718 (SEQ ID NO:383)

The *Arabidopsis* genomic clone 32842 transformed in ME05718 encodes a WD-40 repeat family protein. An alignment of sequences showing similarity to the protein encoded by clone 32842 is presented in FIG. 9. A 16:8 hour light:dark regime was employed in the early flowering validation assay. Two events were chosen to be analyzed in the $T_2$ and the $T_3$ generations. Data showing early flowering and number of rosette leaves at bolting are presented in Tables 9-1 and 9-2. The transgenic plants showed a slight decrease in average rosette diameter compared to the wild-type control, which is possibly caused by reduced number of rosette leaves

TABLE 8-1

T-test comparison of the days to bolting between transgenic plants and pooled non-transgenic segregants.

| Line | Event | Generation | Transgenic Days to Bolting | SE | n | Non-transgenic Days to Bolting | SE | n | p-value |
|---|---|---|---|---|---|---|---|---|---|
| ME09573 | ME09573-01 | T2 | 25.05 | 0.26 | 21 | 27.76 | 0.34 | 21 | 8.16E−08 |
|  |  | T3 | 22.22 | 0.21 | 23 | 24.50 | 0.19 | 12 | 1.52E−09 |
|  | ME09573-02 | T3 | 23.00 | 0.38 | 18 | 27.76 | 0.34 | 21 | 1.90E−11 |
|  |  | T4 | 21.35 | 0.15 | 31 | 24.50 | 0.19 | 12 | 3.45E−16 |

TABLE 8-2

T-test comparison of the number of rosette leaves at bolting between transgenic plants and pooled non-transgenic segregants.

| Line | Event | Generation | Transgenic Number of Rosette Leaves | SE | n | Non-transgenic Number of Rosette Leaves | SE | n | p-value |
|---|---|---|---|---|---|---|---|---|---|
| ME09573 | ME09573-01 | T2 | 8.24 | 0.28 | 21 | 11.10 | 0.32 | 21 | 2.92E−08 |
|  |  | T3 | 8.22 | 0.22 | 23 | 11.33 | 0.26 | 12 | 5.18E−11 |
|  | ME09573-02 | T3 | 6.67 | 0.21 | 18 | 11.10 | 0.32 | 21 | 5.28E−14 |
|  |  | T4 | 7.42 | 0.17 | 31 | 11.33 | 0.26 | 12 | 3.07E−16 |

TABLE 9-1

T-test comparison of the days to bolting between transgenic plants and pooled non-transgenic segregants.

| Line | Events | Generation | Transgenic | | | Non-transgenic | | | |
| --- | --- | --- | --- | --- | --- | --- | --- | --- | --- |
| | | | Days to Bolting | SE | n | Days to Bolting | SE | n | p-value |
| ME05718 | ME05718-02 | T2 | 15.17 | 0.17 | 23 | 18.54 | 0.17 | 35 | 4.33E−20 |
| | | T3 | 16.00 | 0.00 | 11 | 19.54 | 0.10 | 39 | 9.00E−36 |
| | ME05718-03 | T2 | 18.09 | 0.17 | 23 | 18.54 | 0.17 | 35 | 3.05E−02 |
| | | T3 | 18.58 | 0.16 | 24 | 19.54 | 0.10 | 39 | 2.07E−06 |

TABLE 9-2

T-test comparison of the number of rosette leaves at bolting between transgenic plants and pooled non-transgenic segregants.

| Line | Event | Generation | Transgenic | | | Non-transgenic | | | |
| --- | --- | --- | --- | --- | --- | --- | --- | --- | --- |
| | | | Number of Rosette Leaves | SE | n | Number of Rosette Leaves | SE | n | p-value |
| ME05718 | ME05718-02 | T2 | 4.09 | 0.09 | 23 | 7.29 | 0.11 | 35 | 6.12E−31 |
| | | T3 | 4.00 | 0.13 | 11 | 7.18 | 0.10 | 39 | 1.86E−24 |
| | ME05718-03 | T2 | 7.13 | 0.10 | 23 | 7.29 | 0.11 | 35 | 1.39E−01 |
| | | T3 | 6.67 | 0.10 | 24 | 7.18 | 0.10 | 39 | 2.13E−04 |

Example 10

ME02194 (SEQ ID NO:400)

The *Arabidopsis* genomic clone 251923 transformed in ME02194 encodes a putative 60S ribosomal protein L21. An alignment of sequences showing similarity to the protein encoded by clone 251923 is presented in FIG. 10. A 16:8 hour light:dark regime was employed in the early flowering validation assay. Two events were chosen to be analyzed in the $T_2$ and the $T_3$ generations. The same events were also analyzed in the early maturity validation assay. Data showing early flowering, early maturity and number of rosette leaves at bolting are presented in Tables 10-1, 10-2, and 10-3, respectively.

TABLE 10-1

T-test comparison of the days to bolting between transgenic plants and pooled non-transgenic segregants.

| Line | Event | Generation | Transgenic | | | Non-transgenic | | | |
| --- | --- | --- | --- | --- | --- | --- | --- | --- | --- |
| | | | Days to Bolting | SE | n | Days to Bolting | SE | n | p-value |
| ME02194 | ME02194-01 | T2 | 18.74 | 0.14 | 27 | 19.96 | 0.31 | 13 | 4.98E−04 |
| | | T3 | 18.16 | 0.11 | 25 | 18.75 | 0.25 | 12 | 1.89E−02 |
| | ME02194-06 | T2 | 18.03 | 0.19 | 20 | 19.96 | 0.31 | 13 | 4.97E−06 |
| | | T3 | 17.38 | 0.11 | 26 | 18.75 | 0.25 | 12 | 7.88E−06 |

TABLE 10-2

T-test comparison of the days to silique maturing time between transgenic plants and pooled non-transgenic segregants.

| Line | Event | Generation | Transgenic | | | Non-transgenic | | | |
| --- | --- | --- | --- | --- | --- | --- | --- | --- | --- |
| | | | Days to Maturing | SE | n | Days to Maturing | SE | n | p-value |
| ME02194 | ME02194-01 | T2 | 37.42 | 0.11 | 26 | 38.69 | 0.46 | 13 | 5.35E−03 |
| | | T3 | 38.08 | 0.08 | 25 | 38.58 | 0.19 | 12 | 1.07E−02 |
| | ME02194-06 | T2 | 36.65 | 0.20 | 20 | 38.69 | 0.46 | 13 | 1.39E−04 |
| | | T3 | 37.27 | 0.09 | 26 | 38.58 | 0.19 | 12 | 1.96E−07 |

TABLE 10-3

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME02194 | ME02194-01 | T2 | 7.30 | 0.15 | 27 | 8.23 | 0.20 | 13 | 3.10E−04 |
| | | T3 | 5.96 | 0.04 | 25 | 6.25 | 0.13 | 12 | 2.04E−02 |
| | ME02194-06 | T2 | 7.70 | 0.18 | 20 | 8.23 | 0.20 | 13 | 2.89E−02 |
| | | T3 | 5.96 | 0.12 | 26 | 6.25 | 0.13 | 12 | 5.46E−02 |

Example 11

ME03847 (SEQ ID NO:435)

The *Arabidopsis* genomic clone 149496 transformed in ME03847 encodes a putative zinc finger protein. An alignment of sequences showing similarity to the protein encoded by clone 149496 is presented in FIG. 11. A 16:8 hour light:dark regime was employed in the early flowering validation assay. Two events were chosen to be analyzed in the $T_2$ and the $T_3$ generations. The same events were also analyzed in the early maturity validation assay. Data showing early flowering, early maturity and number of rosette leaves at bolting are presented in Tables 11-1, 11-2 and 11-3, respectively.

TABLE 11-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | n | Days to Bolting | SE | n | p-value |
| ME03847 | ME03847-02 | T2 | 17.64 | 0.16 | 29 | 18.78 | 0.19 | 27 | 1.50E−05 |
| | | T3 | 17.03 | 0.11 | 60 | 18.31 | 0.17 | 13 | 1.74E−08 |
| | ME03847-03 | T2 | 18.24 | 0.20 | 33 | 18.78 | 0.19 | 27 | 3.03E−02 |
| | | T3 | 18.17 | 0.10 | 58 | 18.31 | 0.17 | 13 | 2.50E−01 |

TABLE 11-2

T-test comparison of the days to silique maturing time between transgenic plants and pooled non-transgenic segregants.

| | | | Transgenic | | | Non-transgenic | | | |
|---|---|---|---|---|---|---|---|---|---|
| Line | Event | Generation | Days to Maturing | SE | n | Days to Maturing | SE | n | p-value |
| ME03847 | ME03847-02 | T2 | 36.44 | 0.15 | 27 | 37.80 | 0.20 | 5 | 4.11E−06 |
| | | T3 | 37.87 | 0.09 | 60 | 38.92 | 0.18 | 13 | 5.36E−07 |
| | ME03847-03 | T2 | 36.91 | 0.18 | 33 | 37.80 | 0.20 | 5 | 1.09E−03 |
| | | T3 | 38.53 | 0.11 | 58 | 38.92 | 0.18 | 13 | 3.38E−02 |

TABLE 11-3

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME03847 | ME03847-02 | T2 | 6.76 | 0.16 | 29 | 7.63 | 0.19 | 27 | 5.46E−04 |
| | | T3 | 5.77 | 0.06 | 60 | 6.31 | 0.13 | 13 | 2.09E−04 |
| | ME03847-03 | T2 | 7.48 | 0.13 | 33 | 7.63 | 0.19 | 27 | 2.69E−01 |
| | | T3 | 6.33 | 0.06 | 58 | 6.31 | 0.13 | 13 | 4.46E−01 |

Example 12

ME11261 (SEQ ID NO:319)

The *Arabidopsis* genomic clone 231890 transformed in ME11261 encodes a putative AP2-domain-containing protein. An alignment of sequences showing similarity to the protein encoded by clone 231890 is presented in FIG. 6. A 16:8 hour light:dark regime was employed in the early flowering validation assay. Two events were chosen to be analyzed in the $T_2$ and the $T_3$ generations. The same events were also analyzed in the early maturity validation assay. Data showing early flowering, early maturity and number of rosette leaves at bolting are presented in Tables 12-1, 12-2 and 12-3, respectively.

Example 13

ME06492 (SEQ ID NO:449)

The *Arabidopsis* genomic clone 21240 transformed in ME06492 encodes a knotted-1 like homeobox protein (KNAT3). KNOX (knotted1-like homeobox) proteins have been implicated in roles in plant development including meristem maintenance and leaf primordial initiation (Serikawa (1997) Plant J 11: 863-869). An alignment of sequences showing similarity to the protein encoded by clone 21240 is presented in FIG. 12. A 16:8 hour light:dark regime was employed in the early flowering validation assay. Two events were chosen to be analyzed in the $T_2$ and the $T_3$ generations. Data showing early flowering and number of rosette leaves at bolting are presented in Tables 13-1 and 13-2, respectively. The transgenic plants showed a slight decrease in average rosette diameter compared to the wild-type control, which is possibly caused by reduced number of rosette leaves

TABLE 12-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | n | Days to Bolting | SE | n | p-value |
| ME11261 | ME11261-01 | T2 | 17.93 | 0.15 | 27 | 19.28 | 0.51 | 16 | 7.73E−03 |
| | | T3 | 17.50 | 0.11 | 24 | 18.00 | 0.19 | 19 | 1.30E−02 |
| | ME11261-04 | T2 | 18.26 | 0.22 | 23 | 19.28 | 0.51 | 16 | 3.77E−02 |
| | | T3 | 17.17 | 0.20 | 23 | 18.00 | 0.19 | 19 | 2.01E−03 |
| | ME11261-05 | T2 | 17.05 | 0.13 | 32 | 19.28 | 0.51 | 16 | 5.70E−05 |
| | | T3 | 16.66 | 0.15 | 28 | 18.00 | 0.19 | 19 | 5.24E−07 |

TABLE 12-2

T-test comparison of the days to silique maturing time between transgenic plants and pooled non-transgenic segregants.

| | | | Transgenic | | | Non-transgenic | | | |
|---|---|---|---|---|---|---|---|---|---|
| Line | Event | Generation | Days to Maturing | SE | n | Days to Maturing | SE | n | p-value |
| ME11261 | ME11261-01 | T2 | 36.56 | 0.15 | 27 | 38.31 | 0.58 | 16 | 2.62E−03 |
| | | T3 | 37.25 | 0.28 | 24 | 38.00 | 0.28 | 19 | 3.26E−02 |
| | ME11261-04 | T2 | 37.52 | 0.20 | 23 | 38.31 | 0.58 | 16 | 1.01E−01 |
| | | T3 | 37.30 | 0.28 | 23 | 38.00 | 0.28 | 19 | 4.14E−02 |
| | ME11261-05 | T2 | 36.81 | 0.18 | 32 | 38.31 | 0.58 | 16 | 8.17E−03 |
| | | T3 | 36.46 | 0.12 | 28 | 38.00 | 0.28 | 19 | 3.25E−06 |

TABLE 12-3

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME11261 | ME11261-01 | T2 | 6.52 | 0.16 | 27 | 7.06 | 0.32 | 16 | 7.00E−02 |
| | | T3 | 5.67 | 0.10 | 24 | 5.79 | 0.14 | 19 | 2.43E−01 |
| | ME11261-04 | T2 | 6.48 | 0.12 | 23 | 7.06 | 0.32 | 16 | 4.95E−02 |
| | | T3 | 5.35 | 0.10 | 23 | 5.79 | 0.14 | 19 | 8.34E−03 |
| | ME11261-05 | T2 | 6.00 | 0.12 | 32 | 7.06 | 0.32 | 16 | 1.68E−03 |
| | | T3 | 5.21 | 0.12 | 28 | 5.79 | 0.14 | 19 | 1.81E−03 |

TABLE 13-1

T-test comparison of the days to bolting between transgenic plants and pooled non-transgenic segregants.

| | | | Transgenic | | | Non-transgenic | | | |
|---|---|---|---|---|---|---|---|---|---|
| Line | Events | Generation | Days to Bolting | SE | n | Days to Bolting | SE | n | p-value |
| ME06492 | ME06492-04 | T2 | 16.05 | 0.11 | 22 | 16.97 | 0.24 | 16 | 6.53E−04 |
| | | T3 | 15.74 | 0.13 | 29 | 17.66 | 0.19 | 16 | 1.06E−10 |
| | ME06492-07 | T2 | 16.24 | 0.17 | 27 | 16.97 | 0.24 | 16 | 8.40E−03 |
| | | T3 | 16.29 | 0.14 | 21 | 17.66 | 0.19 | 16 | 8.03E−07 |

TABLE 13-2

T-test comparison of the number of rosette leaves at bolting between transgenic plants and pooled non-transgenic segregants.

| | | | Transgenic | | | Non-transgenic | | | |
|---|---|---|---|---|---|---|---|---|---|
| Line | Event | Generation | Number of Rosette Leaves | SE | n | Number of Rosette Leaves | SE | n | p-value |
| ME06492 | ME06492-04 | T2 | 5.55 | 0.11 | 22 | 6.25 | 0.17 | 16 | 6.64E−04 |
| | | T3 | 4.90 | 0.10 | 29 | 5.81 | 0.10 | 16 | 5.81E−08 |
| | ME06492-07 | T2 | 5.85 | 0.14 | 27 | 6.25 | 0.17 | 16 | 3.86E−02 |
| | | T3 | 5.14 | 0.08 | 21 | 5.81 | 0.10 | 16 | 3.78E−06 |

Example 14

ME06561 (SEQ ID NO:463)

The *Arabidopsis* genomic clone 19080 transformed in ME06561 encodes a putative Dof-type zinc finger protein. An alignment of sequences showing similarity to the protein encoded by clone 19080 is presented in FIG. 13. A 16:8 hour light:dark regime was employed in the early flowering validation assay. Two events were chosen to be analyzed in the $T_2$ and the $T_3$ generations. Data showing early flowering and number of rosette leaves at bolting are presented in Tables 14-1 and 14-2, respectively.

TABLE 14-1

T-test comparison of the days to bolting between transgenic plants and pooled non-transgenic segregants.

| | | | Transgenic | | | Non-transgenic | | | |
|---|---|---|---|---|---|---|---|---|---|
| Line | Event | Generation | Days to Bolting | SE | N | Days to Bolting | SE | N | p-value |
| ME06561 | ME06561-02 | T3 | 18.00 | 0.13 | 19 | 19.92 | 0.16 | 52 | 9.48E−14 |
| | | T4 | 16.57 | 0.13 | 15 | 18.21 | 0.15 | 43 | 1.69E−11 |
| | ME06561-03 | T2 | 18.68 | 0.23 | 19 | 19.92 | 0.16 | 52 | 2.06E−05 |
| | | T3 | 16.86 | 0.13 | 18 | 18.21 | 0.15 | 43 | 3.27E−09 |
| | ME06561-05 | T2 | 18.82 | 0.38 | 11 | 19.92 | 0.16 | 52 | 4.65E−03 |
| | | T3 | 17.00 | 0.17 | 18 | 18.21 | 0.15 | 43 | 1.08E−06 |

TABLE 14-2

T-test comparison of the number of rosette leaves between transgenic plants and pooled non-transgenic segregants.

| | | | Transgenic | | | Non-transgenic | | | |
|---|---|---|---|---|---|---|---|---|---|
| Line | Event | Generation | Number of Leaves | SE | N | Number of Leaves | SE | N | p-value |
| ME06561 | ME06561-02 | T3 | 6.11 | 0.13 | 19 | 7.02 | 0.11 | 52 | 8.79E−07 |
| | | T4 | 5.40 | 0.13 | 15 | 6.02 | 0.07 | 43 | 9.95E−05 |
| | ME06561-03 | T2 | 6.00 | 0.08 | 19 | 7.02 | 0.11 | 52 | 7.13E−11 |
| | | T3 | 5.11 | 0.11 | 18 | 6.02 | 0.07 | 43 | 3.53E−09 |
| | ME06561-05 | T2 | 6.27 | 0.24 | 11 | 7.02 | 0.11 | 52 | 5.71E−03 |
| | | T3 | 5.11 | 0.11 | 18 | 6.02 | 0.07 | 43 | 3.53E−09 |

Example 15

ME03027(SEQ ID NO:472)

The *Arabidopsis* genomic clone 33231 transformed in ME03027 encodes a putative aquaporin protein. An alignment of sequences showing similarity to the protein encoded by clone 19080 is presented in FIG. 14. A 16:8 hour light:dark regime was employed in the early flowering validation assay. Two events were chosen to be analyzed in the $T_2$ and the $T_3$ generations. Data showing early flowering and number of rosette leaves at bolting are presented in Tables 15-1 and 15-2, respectively.

TABLE 15-1

T-test comparison of the days to silique maturing time between transgenic plants and pooled non-transgenic segregants.

| Line | Event | Generation | Transgenic | | | Non-transgenic | | | p-value |
|---|---|---|---|---|---|---|---|---|---|
| | | | Days to Maturing | SE | n | Days to Maturing | SE | n | |
| ME03027 | ME03027-02 | T2 | 16.83 | 0.18 | 30 | 18.07 | 0.13 | 7 | 1.16E−06 |
| | | T3 | 17.16 | 0.15 | 32 | 16.75 | 0.41 | 8 | −1.80E−01 |
| | ME03027-05 | T2 | 17.09 | 0.20 | 27 | 18.07 | 0.13 | 7 | 1.31E−04 |
| | | T3 | 17.71 | 0.24 | 24 | 16.75 | 0.41 | 8 | −2.73E−02 |

TABLE 15-2

T-test comparison of the number of rosette leaves at bolting between transgenic plants and pooled non-transgenic segregants.

| Line | Event | Generation | Transgenic | | | Non-transgenic | | | p-value |
|---|---|---|---|---|---|---|---|---|---|
| | | | Number of Rosette Leaves | SE | n | Number of Rosette Leaves | SE | n | |
| ME03027 | ME03027-02 | T2 | 6.03 | 0.03 | 30 | 7.43 | 0.20 | 7 | 3.32E−08 |
| | | T3 | 5.44 | 0.10 | 32 | 5.88 | 0.23 | 8 | 4.26E−02 |
| | ME03027-05 | T2 | 6.59 | 0.11 | 27 | 7.43 | 0.20 | 7 | 4.85E−04 |
| | | T3 | 5.88 | 0.11 | 24 | 5.88 | 0.23 | 8 | 5.00E−01 |

Example 16

ME05742 (SEQ ID NO:555)

The *Arabidopsis* genomic clone 33877 transformed in ME05742 encodes a cyclin family protein. An alignment of sequences showing similarity to the protein encoded by clone 19080 is presented in FIG. 15. A 16:8 hour light:dark regime was employed in the early flowering validation assay. Two events were chosen to be analyzed in the $T_2$ and the $T_3$ generations. Data showing early flowering and number of rosette leaves at bolting are presented in Tables 16-1 and 16-2, respectively.

TABLE 16-1

T-test comparison of the days to silique maturing time between transgenic plants and pooled non-transgenic segregants.

| Line | Event | Generation | Transgenic | | | Non-transgenic | | | p-value |
|---|---|---|---|---|---|---|---|---|---|
| | | | Days to Maturing | SE | n | Days to Maturing | SE | n | |
| ME05742 | ME05742-03 | T2 | 22.50 | 0.20 | 18 | 23.20 | 0.33 | 10 | 3.99E−02 |
| | | T3 | 26.24 | 0.27 | 21 | 26.00 | 0.17 | 22 | −2.29E−01 |
| | ME05742-04 | T2 | 22.25 | 0.25 | 16 | 23.20 | 0.33 | 10 | 1.49E−02 |
| | | T3 | 25.83 | 0.24 | 23 | 26.00 | 0.17 | 22 | 2.81E−01 |

TABLE 16-2

T-test comparison of the number of rosette leaves at bolting between transgenic plants and pooled non-transgenic segregants.

| Line | Event | Generation | Transgenic | | | Non-transgenic | | | p-value |
|---|---|---|---|---|---|---|---|---|---|
| | | | Number of Rosette Leaves | SE | n | Number of Rosette Leaves | SE | n | |
| ME05742 | ME05742-03 | T2 | 10.33 | 0.24 | 18 | 10.47 | 0.22 | 15 | 3.42E−01 |
| | | T3 | 11.05 | 0.18 | 21 | 11.27 | 0.25 | 22 | 2.31E−01 |
| | ME05742-04 | T2 | 9.81 | 0.26 | 16 | 10.47 | 0.22 | 15 | 3.17E−02 |
| | | T3 | 11.09 | 0.23 | 23 | 11.27 | 0.25 | 22 | 2.94E−01 |

Example 17

SALK 060638 (SEQ ID NO: 383)

The DNA sequence (SEQ ID NO: 383) that was used to produce plant line ME05718 (see Example 9) has been deleted or disrupted in the plant line SALK 060638. SALK 108846, where SEQ ID NO: 398 is disrupted or deleted, exhibits earlier flowering than wild type or SALK 060638. The double mutant (SALK 060638×SALK 108846) exhibits later flowering that the wild type or SALK 060638. SALK 060638 and the wild type exhibit larger number of rosette leaves at bolting than the double mutant, which in turn exhibits a higher number of rosette leaves at bolting than SALK 108846. These results suggest that the genes are involved in plant growth and development.

TABLE 17-1

Bolting time, leaf number and rosette size of the single and double mutant in comparison to wild-type Col plants

| Lines | Days to bolting | Rosette leaf number | Cauline leaf number |
|---|---|---|---|
| Wild-type Col | 53.83 ± 1.96 | 48.00 ± 2.67 | 8.49 ± 0.95 |
| | 22.94 ± 1.17 | 13.39 ± 1.40 | 3.28 ± 0.66 |
| At5g52250 KO (SALK 060638) | 52.67 ± 1.15 | 47.25 ± 1.96 | 8.75 ± 0.75 |
| | 22.83 ± 0.94 | 13.33 ± 0.98 | 3.33 ± 0.65 |
| At5g23730 KO (SALK 108846) | 41.42 ± 1.21 | 22.00 ± 1.87 | 5.38 ± 0.58 |
| | 23.79 ± 1.18 | 12.25 ± 1.15 | 3.08 ± 0.28 |

TABLE 17-1-continued

Bolting time, leaf number and rosette size of the single and double mutant in comparison to wild-type Col plants

| Lines | Days to bolting | Rosette leaf number | Cauline leaf number |
|---|---|---|---|
| Double mutant | 59.09 ± 3.41 | 37.45 ± 4.18 | 7.89 ± 1.15 |
| | 26.69 ± 1.19 | 14.08 ± 1.13 | 3.74 ± 0.61 |

Values in short-day (top) and long-day (bottom) conditions shown are mean ± standard deviation; At least 12 plants were scored for each line.

Example 18

ME04402 (Clone 100156; SEQ ID NO:321)

ME04402 contains Clone 100516 and encode an AP2 domain protien. The product of Clone 100156 may interact with transcriptional activators or repressors to regulate expression of the genes controlling flowering time.

Two events, ME04402-02 and -04, were evaluated in the $T_2$ and $T_3$ generations and a t-test used to determine whether the events flower significantly earlier than wild-type Ws at p=0.05 assuming one-tailed distribution and unequal variance.

Events ME04402-02 and -04 showed statistically significant early flowering when compared to non-transgenic segregants in the same event in the same generation (Table 18-1). For ME04402-02 and -04, the days to bolting were decreased by 1.28 and 1.07 days, respectively, as compared to the pooled non-transgenic plants in the $T_2$ generation. In the $T_3$ generation, the values were 0.96 and 0.78 days, respectively. The differences between transgenic and non-transgenic plants were all statistically significant at $p \leq 0.05$ level.

TABLE 18-1

T-test comparison of the days to bolting between transgenic plants and pooled non-transgenic segregants.

| Line | Event | Generation | Transgenic | | | Non-transgenic | | | p-value |
|---|---|---|---|---|---|---|---|---|---|
| | | | Days to Bolting | SE | n | Days to Bolting | SE | n | |
| ME04402 | ME04402-02 | T2 | 17.77 | 0.15 | 24 | 19.05 | 0.19 | 31 | 1.02E−06 |
| | | T3 | 18.04 | 0.12 | 27 | 19.00 | 0.17 | 29 | 1.00E−05 |
| | ME04402-04 | T2 | 19.23 | 0.30 | 11 | 20.30 | 0.25 | 10 | 6.13E−03 |
| | | T3 | 18.17 | 0.29 | 18 | 18.95 | 0.15 | 46 | 9.66E−03 |

Example 19

ME07345 (Clone 101876, SEQ ID NO:564)

ME07345 contains a transgene from *Arabidopsis* that encodes a 156 amino acid protein with unknown function.

Five $T_3$ events were evaluated and a t-test used to determine whether the events flower significantly earlier than wild-type Ws at p=0.05 assuming one-tailed distribution and unequal variance.

Of the five events, two (-02 and -05) showed early flowering while three did not flower earlier than wild-type and were not included in subsequent assays. The T4 generation seeds from the two events were evaluated under the same Early Flowering Assay conditions.

Statistical analysis showed that the T3 and $T_4$ generations of both -02 and -05 had early flowering compared to non-transgenic plants (Table 19-1). For ME07345-02 and -05, the days to bolting were decreased by 0.47 and 0.98 days, respectively, as compared to the pooled non-transgenic plants in the $T_3$ generation. In the $T_4$ generation, the values were 0.91 and 0.9 days, respectively. The differences between transgenic and non-transgenic plants were all statistically significant at $p \leq 0.05$ level.

TABLE 19-1

T-test comparison of the days to bolting between transgenic plants and non-transgenic segregants.

| | | | Transgenic | | | Non-transgenic | | | |
|---|---|---|---|---|---|---|---|---|---|
| Line | Event | Generation | Days to Bolting | SE | N | Days to Bolting | SE | N | p-value |
| ME07345 | ME07345-02 | T3 | 18.39 | 0.14 | 19 | 18.86 | 0.16 | 22 | 1.65E−02 |
| | | T4 | 17.95 | 0.12 | 31 | 18.86 | 0.25 | 11 | 1.17E−03 |
| | ME07345-05 | T3 | 17.88 | 0.13 | 24 | 18.86 | 0.16 | 22 | 9.48E−06 |
| | | T4 | 17.96 | 0.18 | 24 | 18.86 | 0.25 | 11 | 3.19E−03 |

Example 20

ME04195 (Clone 156373, SEQ ID NO:574)

ME04195 contains a transgene from *Arabidopsis* that encodes a 246 amino acid protein containing a homeodomain PHD finger motif at the C-terminus.

Two events in the $T_2$ and $T_3$ generations were evaluated and a t-test used to determine whether the events flower significantly earlier than wild-type Ws at p=0.05 assuming one-tailed distribution and unequal variance.

Events ME04195-01 and -02 showed statistically significant early flowering when compared to non-transgenic segregants in the same event in the same generation (Table 20-1). For ME04195-01 and -02, the days to bolting were decreased by 1.48 and 1.17 days, respectively, as compared to the pooled non-transgenic plants in the $T_2$ generation. In the $T_3$ generation, the values were 1.24 and 1.0 days, respectively. The differences between transgenic and non-transgenic plants were all statistically significant at $p \leq 0.05$ level.

TABLE 20-1

T-test comparison of the days to bolting between transgenic plants and non-transgenic segregants.

| | | | Transgenic | | | Non-transgenic | | | |
|---|---|---|---|---|---|---|---|---|---|
| Line | Event | Generation | Days to Bolting | SE | N | Days to Bolting | SE | N | p-value |
| ME04195 | ME04195-01 | T2 | 18.52 | 0.20 | 27 | 20.00 | 0.52 | 6 | 6.01E−03 |
| | | T3 | 16.97 | 0.13 | 24 | 18.21 | 0.26 | 7 | 1.02E−04 |
| | ME04195-02 | T2 | 18.50 | 0.35 | 18 | 19.67 | 0.49 | 6 | 3.30E−02 |
| | | T3 | 16.83 | 0.41 | 12 | 17.83 | 0.16 | 20 | 1.47E−02 |

Example 21

Determination of Functional Homolog Sequences

The sequences described in the above Examples are utilized as query sequences to identify functional homologs of the query sequences and, together with those sequences, are utilized to define consensus sequences for a given group of query and functional homolog sequences. Query sequences and their corresponding functional homolog sequences are aligned to illustrate conserved amino acids consensus sequences that contain frequently occurring amino acid residues at particular positions in the aligned sequences, as shown in FIGS. 1-17.

A subject sequence is considered a functional homolog of a query sequence if the subject and query sequences encode proteins having a similar function and/or activity. A process known as Reciprocal BLAST (Rivera et al, (1998) *Proc. Natl. Acad. Sci. USA* 95:6239-6244) is used to identify potential functional homolog sequences from databases consisting of all available public and proprietary peptide sequences, including NR from NCBI and peptide translations from Ceres clones.

Before starting a Reciprocal BLAST process, a specific query polypeptide is searched against all peptides from its source species using BLAST in order to identify polypeptides having sequence identity of 80% or greater to the query polypeptide and an alignment length of 85% or greater along the shorter sequence in the alignment. The query polypeptide and any of the aforementioned identified polypeptides are designated as a cluster.

The main Reciprocal BLAST process consists of two rounds of BLAST searches; forward search and reverse search. In the forward search step, a query polypeptide sequence, "polypeptide A," from source species SA is BLASTed against all protein sequences from a species of interest. Top hits are determined using an E-value cutoff of $10^{-5}$ and an identity cutoff of 35%. Among the top hits, the sequence having the lowest E-value is designated as the best hit, and considered a potential functional homolog. Any other top hit that had a sequence identity of 80% or greater to the best hit or to the original query polypeptide is considered a potential functional homolog as well. This process is repeated for all species of interest.

In the reverse search round, the top hits identified in the forward search from all species are used to perform a BLAST search against all protein or polypeptide sequences from the source species $S^A$. A top hit from the forward search that returned a polypeptide from the aforementioned cluster as its best hit is also considered as a potential functional homolog.

Functional homologs are identified by manual inspection of potential functional homolog sequences. Representative functional homologs are shown in FIGS. 1-17. The Figures represents a grouping of a query sequence aligned with the corresponding identified functional homolog subject sequences. Query sequences and their corresponding functional homolog sequences are aligned to identify conserved amino acids and to determine a consensus sequence that contains a frequently occurring amino acid residue at particular positions in the aligned sequences, as shown in FIGS. 1-17.

An HMM was made based on SEQ ID NO:96, 100, 105, 106, 107 and 108, aligned in FIG. 1. When fit to the HMM profile, SEQ ID NO:96, 98, 100, 102, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 603, and 605 gave HMM bit scores of 627.2, 482.7, 590.6, 457.2, 558.2, 633.1, 633.6, 632, 625.7, 638.1, 632.2, 438.9, 434.8, 389.3, 457.2, 544.8, 365.7, 368.7, 365.9, 510.1, 623.6, 572.8, 429.6, 445.7, 469.5, 620.8, 516.6, 540.1, 627.5, 495.7, 518.5, 516.1, 581.6, 376.9, 449.8, 518.2, 482.7, 522.8, 625.1, 597, and 66.2 respectively.

An HMM was made based on SEQ ID NO:140, 144, 148, 150, 159, 160 and 161, aligned in FIG. 2. When fit to the HMM profile, SEQ ID NO:140, 142, 144, 146, 148, 150, 152, 154, 156, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, and 194 gave HMM bit scores of 653, 652.9, 625.2, 561.2, 665, 665.9, 614.4, 604.7, 622.1, 606.9, 647.8, 652.9, 618, 661.8, 573.6, 635.8, 651.6, 511.9, 512, 637.3, 641.2, 633.2, 639.6, 638.1, 641, 628.3, 665, 532, 600.2, 594.4, 664.7, 614.1, 565.6, 536, 625.2, 587.4, 660, 594.5, 593.5, 557.2, 519.2, 513.6, 552.5, 545.8, 539.3, and 535 respectively.

An HMM was made based on SEQ ID NO:196, 198, 204, 207, 208, and 209 aligned in FIG. 3. When fit to the HMM profile, SEQ ID NO:196, 198, 200, 202, 204, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, and 236 gave HMM bit scores of 497.8, 498.2, 497.8, 478.5, 508.1, 502.6, 510.9, 522.9, 521.4, 450.6, 477, 442.2, 486.2, 439.9, 439.4, 437, 484.1, 451.4, 502.4, 441, 481.3, 461.5, 489.9, 461.9, 480.4, 480.4, 452.7, 443.8, 465.8, 481.4, 507.4, 483.8, 462.6, 505.2, 435 and 440.2 respectively.

An HMM was made based on SEQ ID NO:238, 240, 244, 250, 251, 252, and 254 aligned in FIG. 4. When fit to the HMM profile, SEQ ID NO:238, 240, 242, 244, 246, 248, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, and 283 gave HMM bit scores of 572.1, 565.6, 558.5, 557.8, 524.5, 524.5, 579.8, 540.6, 589.4, 562.2, 516.4, 519.6, 524.5, 506.8, 558.5, 565.6, 528.7, 524.7, 523.3, 527.2, 544.5, 537.5, 553.8, 535.4, 537.5, 521.1, 536.7, 562, 557.8, 534.3, 506.6, 556.7, 558.8, 563.6, 563.6, 563.4, 548.6, 561.6, 519.8 and 511.8 respectively.

An HMM was made based on SEQ ID NO:285, 287, 291, 293, and 296 aligned in FIG. 5. When fit to the HMM profile, SEQ ID NO:285, 287, 289, 291, 293, 295, 296, and 297 gave HMM bit scores of 386.6, 429.1, 269.7, 636.2, 338.6, 542.2, 441.8 and 429.2 respectively.

An HMM was made based on SEQ ID NO:299, 301, 305, 307, 309, 311, 315, 316, 320, and 322, aligned in FIG. 6. When fit to the HMM profile, SEQ ID NO:299, 301, 303, 305, 307, 309, 311, 313, 315, 316, 317, 318, 320, 322, 324, and 325 gave HMM bit scores of 520, 519.5, 510.5, 510.5, 519.9, 1086.7, 529.7, 367.9, 531.7, 542.3, 520.5, 519.9, 587, 520.5, 511.9, and 542.3 respectively.

Figure 7:
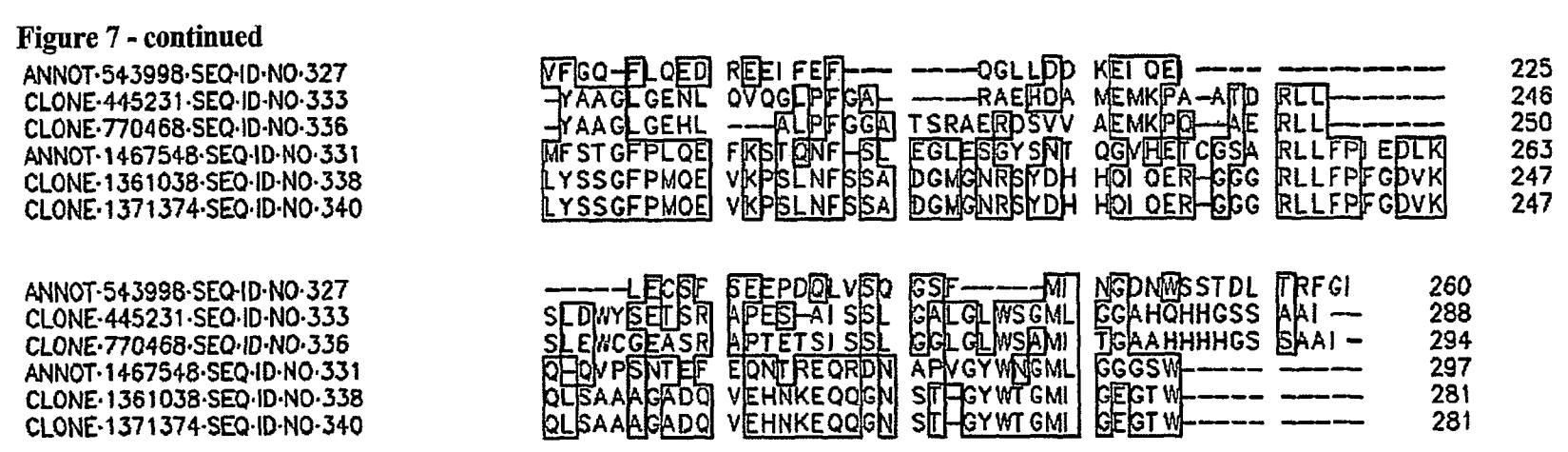

An HMM was made based on SEQ ID NO:327, 331, 333, 336, 338, 340, and 607, aligned in FIG. 7. When fit to the HMM profile, SEQ ID NO:327, 329, 331, 333, 334, 336, 338, 340, and 607 gave HMM bit scores of 555.4, 700.4, 680.3, 648.9, 687.7, 673.3, 624.9, 624.9, and 687.7 respectively.

Figure 8:
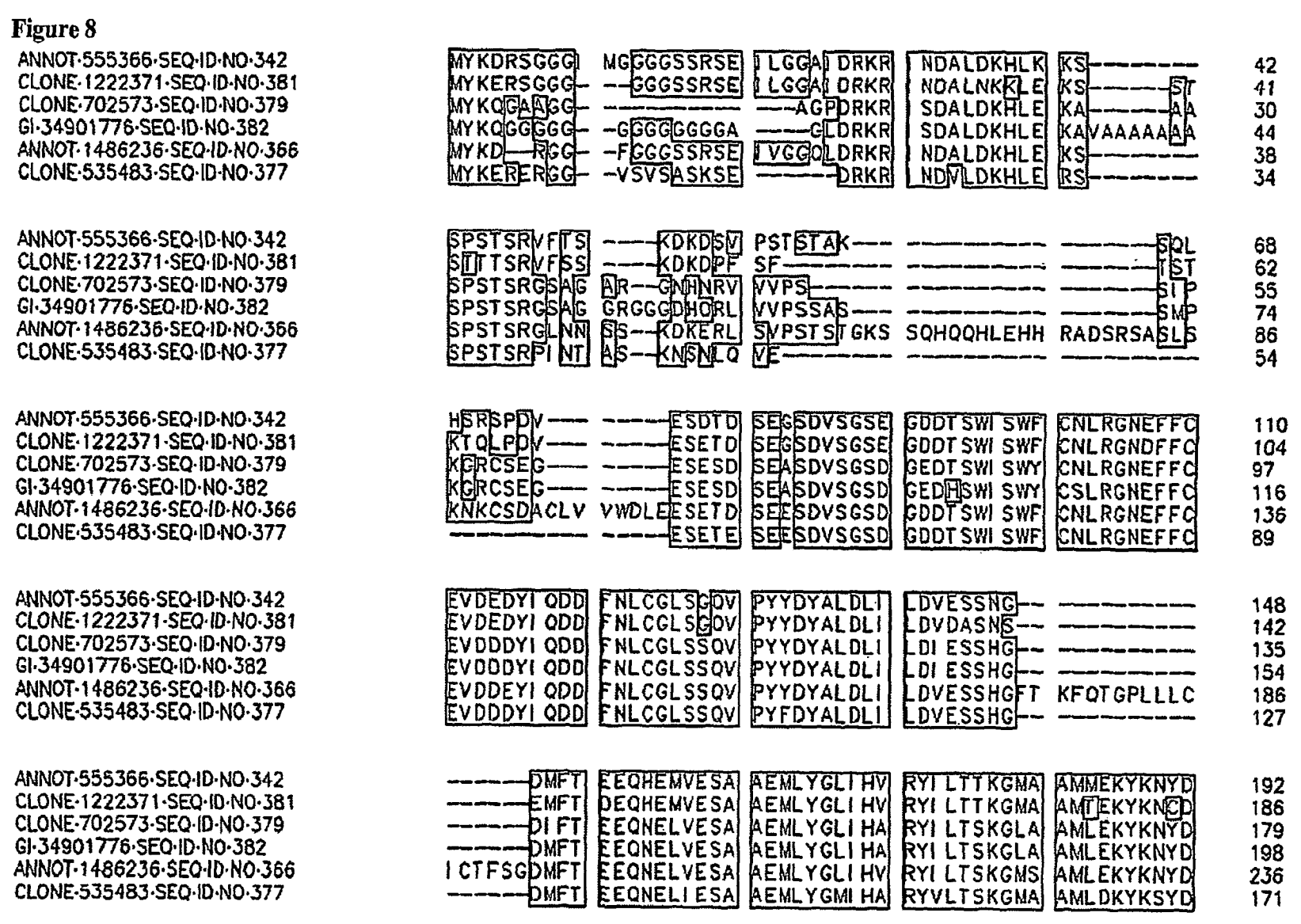

An HMM was made based on SEQ ID NO:342, 366, 377, 379, 381, and 382, aligned in FIG. 8. When fit to the HMM profile, SEQ ID NO:342, 344, 346, 348, 350, 352, 354, 356, 358, 360, 362, 364, 366, 368, 370, 371, 372, 373, 374, 375, 377, 379, 381, and 382 gave HMM bit scores of 758, 758.2, 619.5, 764.3, 715.9, 698, 693.2, 698, 629.5, 698, 605.7, 634.4, 602.9, 610.3, 682.4, 731.1, 602.1, 723, 675.6, 648.3, 698, 710.4, 731.1, and 727.9 respectively.

An HMM was made based on SEQ ID NO:384, 394, 396, 397, and 399 aligned in FIG. 9. When fit to the HMM profile, SEQ ID NO:384, 386, 388, 390, 392, 394, 396, 397, 399 gave HMM bit scores of 904.9, 908, 916.6, 696.7, 744.9, 969.9, 955.3, 916.6, and 908 respectively.

Figure 17:
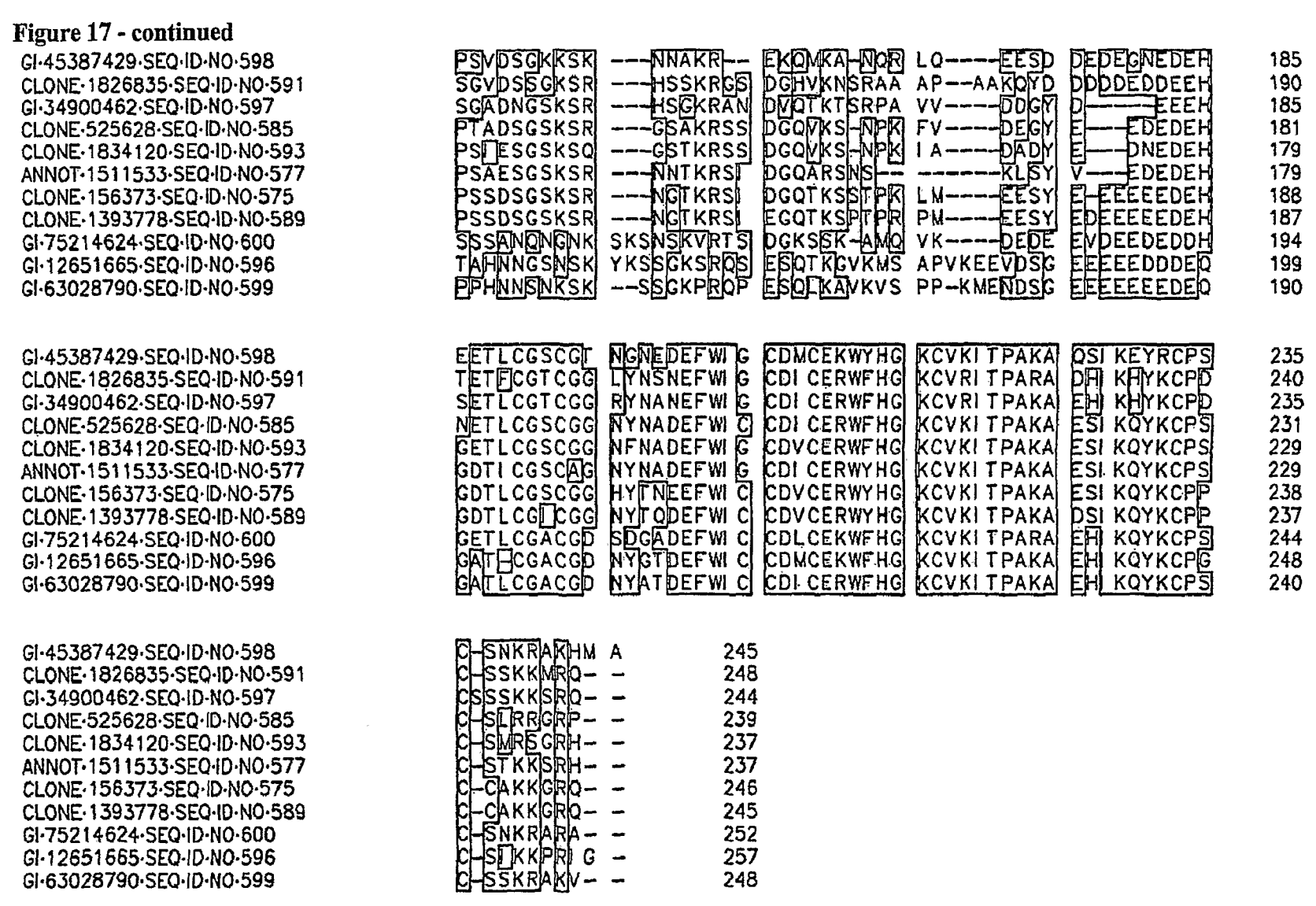

An HMM was made based on SEQ ID NOs 575, 577, 585, 589, 591, 593, 596, 597, 598, 599 and 600, aligned in FIG. 17. When fit to the HMM, SEQ ID NOs 575, 577, 579, 581, 583, 585, 587, 589, 591, 593, 595, 596, 597, 598, 599, 600 and 601 gave HMM bit scores of 587.2, 556.7, 547.6, 571.2, 543.1, 574.6, 572.1, 581.8, 549, 554.1, 545.4, 541.4, 553.7, 565, 562, 561.7 and 550 respectively.

An HMM was made based on SEQ ID NOs 565, 567, 571, and 573, aligned in FIG. 16. When fit to the HMM, SEQ ID NOs 565, 567, 569, 571, and 573 gave HMM bit scores of 341.5, 394.6, 313.3, 221 and 439.9 respectively.

An HMM was made based on SEQ ID NOs 556, 560, 562 and 563, aligned in FIG. 15. When fit to the HMM, SEQ ID NOs 556, 558, 560, 562 and 563 gave HMM bit scores of 752.9, 1053.3, 1101.1, 1086.7 and 1497.2 respectively.

Figure 14:
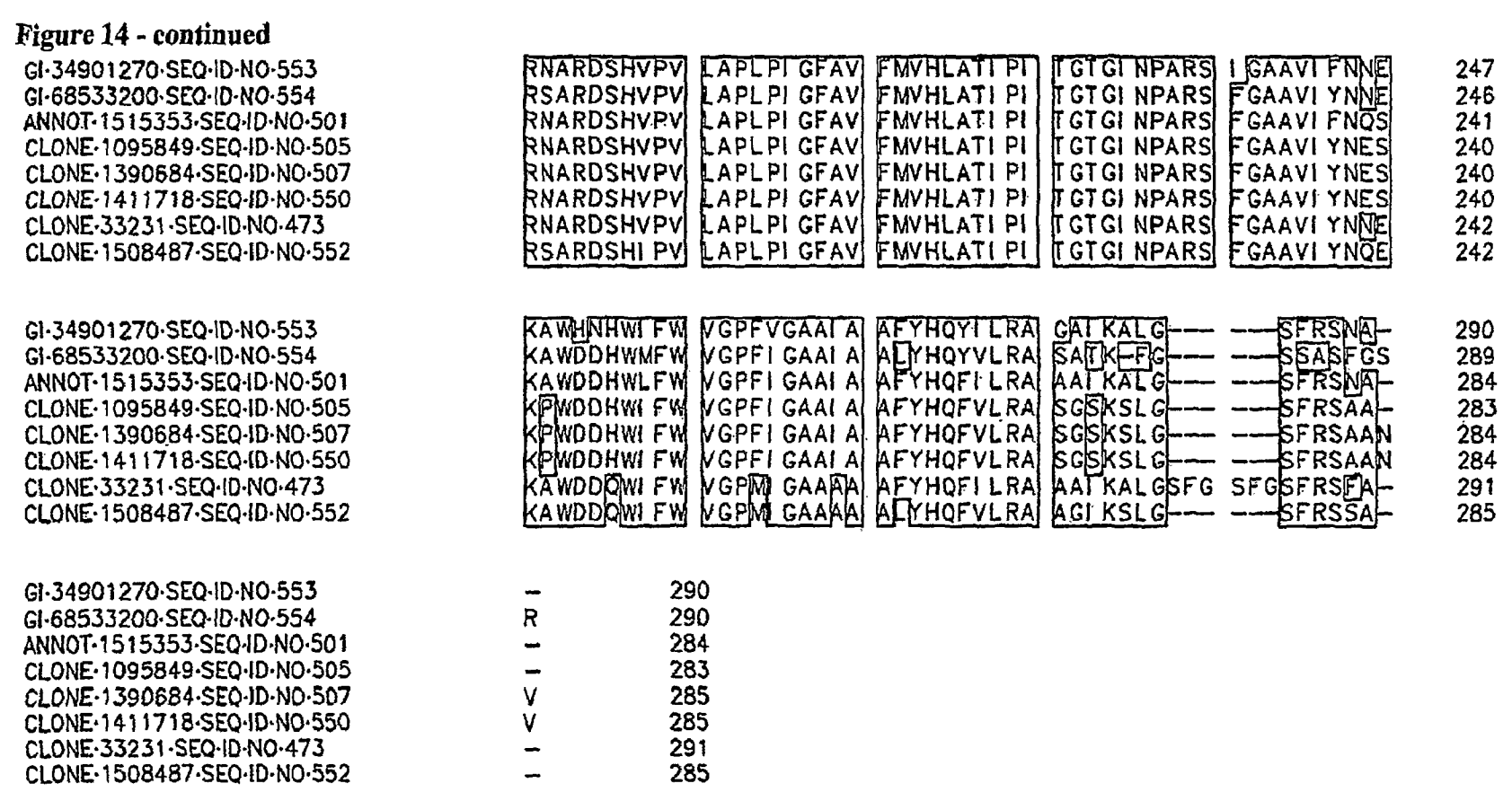

An HMM was made based on SEQ ID NOs 473, 501, 505, 507, 550, 552, 553 and 554, aligned in FIG. 14. When fit to the HMM, SEQ ID NOs 473, 475, 477, 479, 481, 483, 485, 487, 489, 491, 493, 495, 497, 499, 501, 503, 505, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 550, 552, 553 and 554 gave HMM bit scores of 780.9, 741.5, 764.3, 763.5, 765.6, 765.6, 742.3, 762.7, 752.1, 749, 754.7, 743.2, 752.4, 750.9, 790, 752.4, 778.3, 779.4, 760.8, 762.6, 753.3, 769.5, 764.3, 771.5, 739.8, 738, 763.6, 778.3, 774.7, 778.1, 729.7, 752.4, 752.1, 739.5, 746.7, 755.2, 758.6, 741.9, 761.6, 762.7, 769, 757.8, 761, 748.9, 724.3, 751.2, 743.1, 752.1, 739.8, 734.6, 757, 754.7, 708.8, 757.8, 713.2, 739.6, 740, 758, 744.9, 779.4, 788.8, 764.8 and 762.7 respectively.

An HMM was made based on SEQ ID NOs 464, 467, 469, 470 and 471, aligned in FIG. 13. When fit to the HMM, SEQ ID NOs 464, 465, 467, 469, 470 and 471 gave HMM bit scores of 762.8, 576.5, 828.8, 877.5, 646 and 686.8 respectively.

Figure 12:
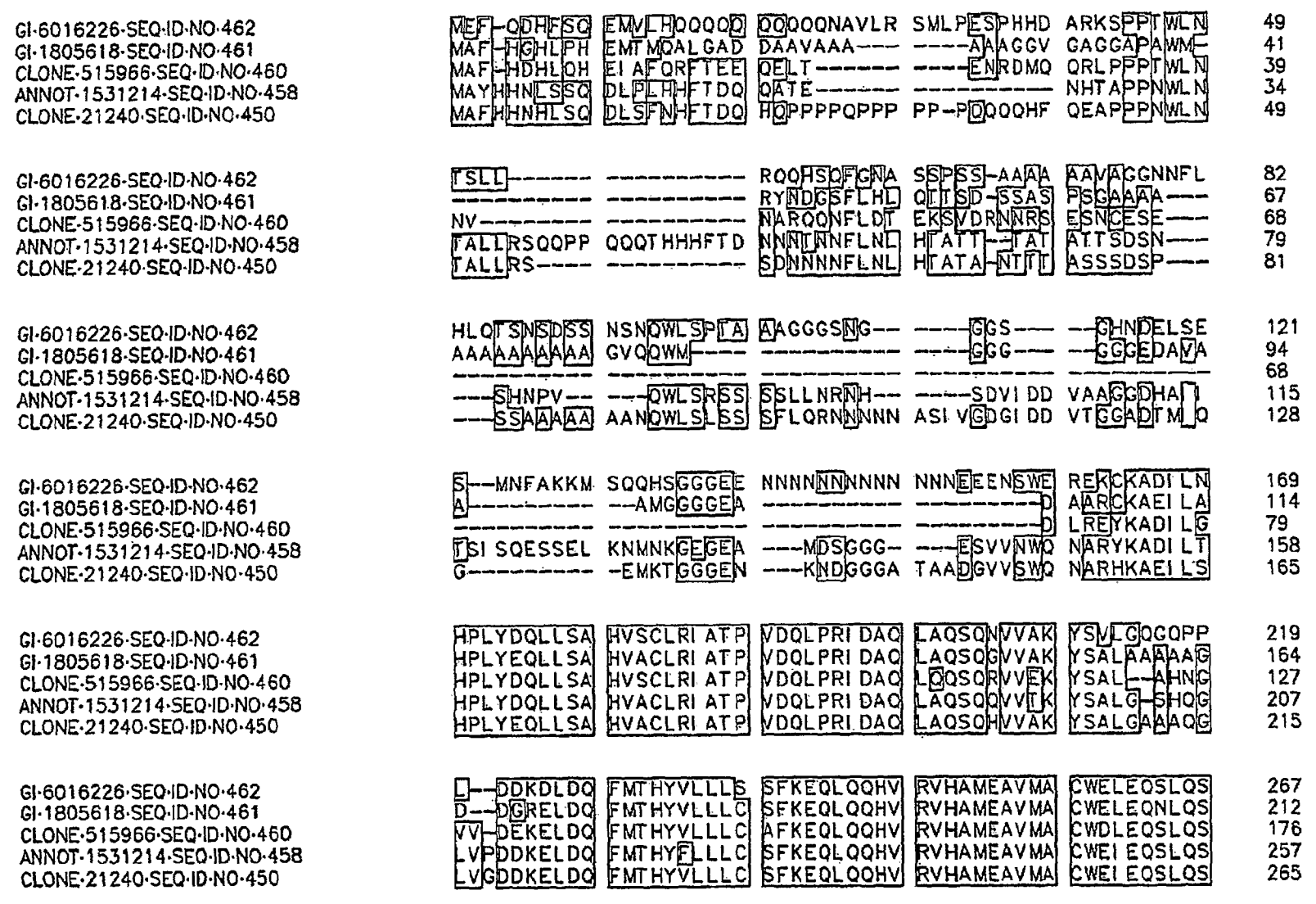

An HMM was made based on SEQ ID NOs 450, 458, 460, 461 and 462, aligned in FIG. 12. When fit to the HMM, SEQ ID NOs 450, 452, 453, 454, 455, 456, 458, 460, 461 and 462 gave HMM bit scores of 988.2, 908.6, 806.2, 801.5, 812.6, 813.9, 950.1, 781.2, 811.8 and 901.6 respectively.

An HMM was made based on SEQ ID NOs 436, 443, 445, 447, 448 and 609 aligned in FIG. 11. When fit to the HMM, SEQ ID NOs 436, 438, 439, 440, 441, 443, 445, 447, 448 and 609 gave HMM bit scores of 996.1, 713.20, 719.9, 960.8, 715.6, 1098.4, 1205, 1205, 1199.1 and 688.7 respectively.

An HMM was made based on SEQ ID NOs 401, 427, 429, 431, 433 and 434, aligned in FIG. 10. When fit to the HMM, SEQ ID NOs 401, 403, 405, 407, 409, 411, 413, 415, 417, 419, 421, 423, 424, 425, 427, 429, 431, 433 and 434 gave HMM bit scores of 478.9, 464.8, 477.4, 479.6, 458.6, 472.1, 477.9, 470.5, 452.3, 469.7, 470.4, 478.7, 477.4, 481, 481.2, 479.6, 477.9, 474 and 485 respectively.

Useful polypeptides of the invention include each of the lead and corresponding functional homolog sequences shown in the Figures and/or the Sequence Listing, as well as polypeptides belonging to the corresponding consensus sequence families as delineated by HMMs. In different embodiments, consensus sequence families have HMM bit score lower limits as about 50%, 60%, 70%, 80%, 90%, or 95% of any of the HMM bit scores of the family members presented in this application. In some embodiments the lower HMM bit score limits correspond approximately to the HMM bit score of any of the family members disclosed in this application. A sequence that has an HMM bit score of 20 means that it has a 95% likelihood of belonging to the consensus sequence defined by a particular HMM. Alternative HMM bit scores that are useful for the current invention are 50, 75, 100, 125, 150, 200, 250, 300, 350, 400, 450 and 500.

The present invention further encompasses nucleotides that encode the above described polypeptides, as well as the complements thereof, and including alternatives thereof based upon the degeneracy of the genetic code.

The invention being thus described, it will be apparent to one of ordinary skill in the art that various modifications of the materials and methods for practicing the invention can be made. Such modifications are to be considered within the scope of the invention as defined by the following claims.

The following references are cited in the Specification. Each of the references from the patent and periodical literature cited herein is hereby expressly incorporated in its entirety by such citation.

REFERENCES (1) Koomneef, M., Alonso-Blanco, C., Peeters, A. J. M., and Soppe, W. (1998) *Annu. Rev. Plant. Physiol. Mol. Biol.*, 49: 345-370.
(2) Zhang et al. (2004) *Plant Physiol.* 135:615.
(3) Walbot, V. (1985) *Trends Genet.*, 1:165-169.
(4) Gamer, W. W. and Allard, H. A. (1920) *J. Agric. Res.*, 18:553-606.
(5) Bernier, G (1988) *Annu. Rev. Plant Physiol. Plant Mol. Biol.*, 39:175-219.
(6) Millar, A. J. (1999) *New Phytol.*, 14:175-197.
(7) Battey, N. H. (2000) *J. Exp. Bot.*, 51:1769-1780.
(8) Samach, A. and Coupland, G. (2000) *Bioessays*, 22:38-47.
(9) Salomon et al. (1984) *EMBO. J.* 3:141.
(10) Herrera-Estrella et al. (1983) *EMBO J.* 2:987.
(11) Escudero et al. (1996) *Plant J* 10:355.
(12) Ishida et al. (1996) *Nature Biotechnology* 14:745.
(13) May et al. (1995) *Bio/Technology* 13:486)
(14) Armaleo et al. (1990) *Current Genetics* 17:97.
(15) P. Tijessen, "Hybridization with Nucleic Acid Probes" In Laboratory Techniques in Biochemistry and Molecular Biology, P. C. vand der Vliet, ed., c. 1993 by Elsevier, Amsterdam.
(16) Bonner et al., (1973) *J. Mol. Biol.* 81:123.
(17) Xu et al. (1995) *Plant Mol. Biol.* 27:237.
(18) Sambrook et al., Molecular Cloning: A Laboratory Manual, Second Edition, Cold Spring Harbor Laboratory Press, 1989, New York.
(19) Shizuya et al. (1992) *Proc. Natl. Acad. Sci. USA*, 89: 8794-8797.
(20) Hamilton et al. (1996) *Proc. Natl. Acad. Sci. USA*, 93: 9975-9979.
(21) Burke et al. (1987) *Science*, 236:806-812.
(22) Sternberg N. et al. (1990) *Proc Natl Acad Sci USA.*, 87:103-7.
(23) Bradshaw et al. (1995) *Nucl Acids Res*, 23: 4850-4856.
(24) Frischauf et al. (1983) *J. Mol Biol*, 170: 827-842.
(25) Huynh et al., Glover N. Mex. (ed) DNA Cloning: A practical Approach, Vol. 1 Oxford: IRL Press (1985).
(26) Walden et al. (1990) *Mol Cell Biol* 1: 175-194.
(27) Fromm et al. (1989) *The Plant Cell* 1:977-984.
(28) Jordano, et al. (1989) *Plant Cell*, 1:855-866.
(29) Bustos, et al. (1989) *Plant Cell*, 1:839-854.
(30) Green, et al. (1988) *EMBO J.* 7, 4035-4044.
(31) Meier, et al. (1991) *Plant Cell*, 3, 309-316.
(32) Zhang, et al. (1996) *Plant Physiology* 110: 1069-1079.
(33) Lam et al. (1989) *Proc. Natl. Acad. Sci. USA* 86:7890-7894.
(34) Conkling et al. (1990) *Plant Physiol.* 93:1203-1211.
(35) Bustos et al. (1989) *Plant Cell* 1(9):839-853.
(36) Riggs et al. (1989) *Plant Cell* 1(6):609-621.
(37) Baerson et al. (1993) *Plant Mol Biol*, 22(2):255-267.
(38) Slocombe et al. (1994 *Plant Physiol* 104(4):167-176).
(39) Chen et al. (1986) *Proc Natl Acad Sci USA* 83:8560-8564.
(40) Hong et al. (1997) *Plant Mol Biol* 34(3):549-555.
(41) Zheng et al. (1993) *Mol. Cell. Biol.* 13:5829-5842.
(42) Urao (1996) *Plant Mol. Biol.*, 32:571-57.
(43) Conceicao (1994) *Plant*, 5:493-505.
(44) Sheridan (1996) *Genetics*, 142:1009-1020.
(45) Abler, *Plant Mol. Biol.*, 22:10131-1038 (1993).
(46) Yamamoto et al. (1994) *Plant Cell Physiol.* 35:773-778.
(47) Fejes et al., (1990) *Plant Mol. Biol.* 15:921-932.
(48) Lubberstedt et al. (1994) *Plant Physiol.* 104:997-1006.
(49) Luan et al. (1992) *Plant Cell* 4:971-981.
(50) Matsuoka et al. (1993) *Proc Natl Acad. Sci. USA* 90:9586-9590.
(51) Cerdan et al. (1997) *Plant Mol. Biol.* 33:245-255.
(52) Truernit et al. (1995) *Planta* 196:564-570.
(53) Perriman, et al. (1995) *Proc. Natl. Acad. Sci. USA*, 92(13):6175-6179.
(54) de Feyter and Gaudron, Methods in *Molecular Biology*, Vol. 74, Chapter 43, "Expressing Ribozymes in Plants", Edited by Turner, P. C, Humana Press Inc., Totowa, N.J.
(55) Summerton and Weller, 1997, *Antisense Nucleic Acid Drug Dev.*, 7:187-195.
(56) Hyrup et al. (1996) *Bioorgan. Med. Chem.*, 4: 5-23.
(57) Vissenberg et al. (2005) *Plant Cell Physiol* 46:192.
(58) Husebye et al. (2002) *Plant Physiol* 128:1180.
(59) Plesch et al. (2001) *Plant J* 28:455.
(60) Griesbach (1987) *Plant Sci.* 50:69-77.
(61) Fromm et al. (1985) *Proc. Natl. Acad. Sci. USA* 82:5824.
(62) Paszkowski et al. (1984) *EMBO J.* 3:2717.
(63) Klein et al. (1987) *Nature* 327:773.
(64) Willmitzer, L. (1993) Transgenic Plants. In: iotechnology, A Multi-Volume Comprehensive treatise (H. J. Rehm,

(65) *Crit. Rev. Plant. Sci.* 4:1-46.
(66) Fromm et al. (1990) *Biotechnology* 8:833-844.
(67) Cho et al. (2000) *Planta* 210:195-204.
(68) Brootghaerts et al. (2005) *Nature* 433:629-633.
(69) Lincoln et al. (1998) *Plant Mol. Biol. Rep.* 16:1-4.
(70) Lacomme et al. (2001), "Genetically Engineered Viruses" (C. J. A. Ring and E. D. Blair, Eds). Pp. 59-99, BIOS Scientific Publishers, Ltd. Oxford, UK.
(71) Parenicova, L., Folter, S. D., Kieffer, M., Horner, D. S., Favalli, C., Busscher, J., Cook, H. E., Ingram, R. M., Kater, M. M., Davies, B., Angenent, G. C., and Colombo, L. (2003) Molecular and phylogenetic analyses of the complete MADS-box transcription factor family in *Arabidopsis*: new openings to the MADS world. Plant Cell 15:1538-1551.
(72) Jofuku, K. D., der Boer, B. G. W., Van Montagu, M., and Okamuro, J. K. (1994) Control of *Arabidopsis* flower and seed development by the homeotic gene APETAL2. Plant Cell 6: 1211-1225.
(73) Umemura, Y., Ishiduka, Y., Yamamoto, R., and Esaka, M. (2004) The D of domain, a zinc finger DNA-binding domain conserved only in higher plants, truly functions as a Cys2/Cys2 Zn finger domain. Plant J. 37: 741-749.
(74) Sugano, S., Andronis, C., Green, R. M., Wang, Z., and Tobin, E. M. (1998) Protein kinase CK2 interacts with and phosphorylates the *Arabidopsis* circadian clock-associated 1 protein. Proc. Natl. Acad. Sci. USA 95: 11020-11025.
(75) Neer, E. J., Schmidt, C. J., Nambudripad, R., and Smith, T. F. (1994) The ncient regulatory-protein family of WD-repeat proteins. Nature 371: 297-300.
(76) Wang, G., Kong, H., Sun, Y., Zhang, X., Zhang, W., Altman, N., dePamphilis, C. W., and Ma, H. (2004) Genome-wide analysis of the cyclin family in *Arabidopsis* and comparative phylogenetic analysis of plant cyclin-like proteins. Plant Physiol. 135: 1084-1099.
(77) Serikawa, K. A., Zambryski, P. C. (1997) Domain exchanges between KNAT3 and KNAT1 suggest specificity of the kn1-like homeodomains requires sequences outside of the third helix and N-terminal arm of the homeodomain. Plant J 11:863-869.
(78) Crouzet, M. and Begueret J. (1980) A new mutant form of the ribosomal protein L21 in the fungus Podospora anserina: identification of the structural gene for this protein. Mol Gen Genet. 180(1):177-83.

SEQUENCE LISTING (609 sequences)

SEQ ID NO: 1 - DNA, 1823 bp, Arabidopsis thaliana
  misc_feature (1)..(1823): Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 2 - DNA, 1000 bp, Arabidopsis thaliana
  misc_feature (1)..(1000): Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 3 - DNA, 1000 bp, Arabidopsis thaliana
  misc_feature (1)..(1000): Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 4 - DNA, 999 bp, Arabidopsis thaliana
  misc_feature (1)..(999): Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 5 - DNA, 1000 bp, Arabidopsis thaliana
  misc_feature (1)..(1000): Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 6 - DNA, 351 bp, Arabidopsis thaliana
  misc_feature (1)..(351): Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 7 - DNA, 1022 bp, Arabidopsis thaliana
  misc_feature (1)..(1022): Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 8 - DNA, 1000 bp, Arabidopsis thaliana
  misc_feature (1)..(1000): Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 9 - DNA, 998 bp, Arabidopsis thaliana
  misc_feature (1)..(998): Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 10 - DNA, 1000 bp, Arabidopsis thaliana
  misc_feature (1)..(1000): Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 11 - DNA, 999 bp, Arabidopsis thaliana
  misc_feature (1)..(999): Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 12 - DNA, 1000 bp, Arabidopsis thaliana
  misc_feature (1)..(1000): Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 13 - DNA, 998 bp, Arabidopsis thaliana
  misc_feature (1)..(998): Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 14 - DNA, 1000 bp, Arabidopsis thaliana
  misc_feature (1)..(1000): Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 15 - DNA, 1000 bp, Arabidopsis thaliana
  misc_feature (1)..(1000): Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 16 - DNA, 1000 bp, Arabidopsis thaliana
  misc_feature (1)..(1000): Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 17 - DNA, 1000 bp, Arabidopsis thaliana
  misc_feature (1)..(1000): Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 18 - DNA, 1000 bp, Arabidopsis thaliana
  misc_feature (1)..(1000): Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 19 - DNA, 1002 bp, Arabidopsis thaliana
  misc_feature (1)..(1002): Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 20 - DNA, 1001 bp, Arabidopsis thaliana
  misc_feature (1)..(1001): Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 21 - DNA, 1024 bp, Arabidopsis thaliana
  misc_feature (1)..(1024): Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 22 - DNA, 1000 bp, Arabidopsis thaliana
  misc_feature (1)..(1000): Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 23 - DNA, 921 bp, Arabidopsis thaliana
  misc_feature (1)..(921): Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 24 - DNA, 763 bp, Arabidopsis thaliana
  misc_feature (1)..(763): Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 25 - DNA, 751 bp, Arabidopsis thaliana
  misc_feature (1)..(751): Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 26 - DNA, 669 bp, Arabidopsis thaliana
  misc_feature (1)..(669): Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 27 - DNA, 702 bp, Arabidopsis thaliana
  misc_feature (1)..(702): Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 28 - DNA, 435 bp, Arabidopsis thaliana
  misc_feature (1)..(435): Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 29 - DNA, 397 bp, Arabidopsis thaliana
  misc_feature (1)..(397): Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 30 - DNA, 1024 bp, Arabidopsis thaliana
  misc_feature (1)..(1024): Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 31 - DNA, 1000 bp, Arabidopsis thaliana
  misc_feature (1)..(1000): Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 32 - DNA, 999 bp, Arabidopsis thaliana
  misc_feature (1)..(999): Ceres Promoter YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 33 - DNA, 1024 bp, Arabidopsis thaliana
  misc_feature (1)..(1024): Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 34 - DNA, 1024 bp, Arabidopsis thaliana
  misc_feature (1)..(1024): Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 35 - DNA, 1024 bp, Arabidopsis thaliana
  misc_feature (1)..(1024): Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 36 - DNA, 999 bp, Arabidopsis thaliana
  misc_feature (1)..(999): Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 37 - DNA, 1024 bp, Arabidopsis thaliana
  misc_feature (1)..(1024): Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 38 - DNA, 1024 bp, Arabidopsis thaliana
  misc_feature (1)..(1024): Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 39 - DNA, 1020 bp, Arabidopsis thaliana
  misc_feature (1)..(1020): Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 40 - DNA, 1000 bp, Arabidopsis thaliana
  misc_feature (1)..(1000): Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 41 - DNA, 1004 bp, Arabidopsis thaliana
  misc_feature (1)..(1004): Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 42 - DNA, 1000 bp, Arabidopsis thaliana
  misc_feature (1)..(1000): Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 43 - DNA, 1004 bp, Arabidopsis thaliana
  misc_feature (1)..(1004): Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 44 - DNA, 1003 bp, Arabidopsis thaliana
  misc_feature (1)..(1003): Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 45 - DNA, 1024 bp, Arabidopsis thaliana
  misc_feature (1)..(1024): Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 46 - DNA, 1024 bp, Arabidopsis thaliana
  misc_feature (1)..(1024): Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 47 - DNA, 996 bp, Arabidopsis thaliana
  misc_feature (1)..(996): Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 48 - DNA, 1024 bp, Arabidopsis thaliana
  misc_feature (1)..(1024): Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 49 - DNA, 1000 bp, Arabidopsis thaliana
  misc_feature (1)..(1000): Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 50 - DNA, 999 bp, Arabidopsis thaliana
  misc_feature (1)..(999): Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 51 - DNA, 999 bp, Arabidopsis thaliana
  misc_feature (1)..(999): Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 52 - DNA, 1004 bp, Arabidopsis thaliana
  misc_feature (1)..(1004): Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 53 - DNA, 1001 bp, Arabidopsis thaliana
  misc_feature (1)..(1001): Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 54 - DNA, 1001 bp, Arabidopsis thaliana
  misc_feature (1)..(1001): Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 55 - DNA, 1003 bp, Arabidopsis thaliana
  misc_feature (1)..(1003): Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 56 - DNA, 1004 bp, Arabidopsis thaliana
  misc_feature (1)..(1004): Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 57 - DNA, 1000 bp, Arabidopsis thaliana
  misc_feature (1)..(1000): Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 58 - DNA, 1005 bp, Arabidopsis thaliana
  misc_feature (1)..(1005): Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 59 - DNA, 1002 bp, Arabidopsis thaliana
  misc_feature (1)..(1002): Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 60 - DNA, 995 bp, Arabidopsis thaliana
  misc_feature (1)..(995): Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 61 - DNA, 1024 bp, Arabidopsis thaliana
  misc_feature (1)..(1024): Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 62 - DNA, 911 bp, Arabidopsis thaliana
  misc_feature (1)..(911): Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 63 - DNA, 999 bp, Arabidopsis thaliana
  misc_feature (1)..(999): Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 64 - DNA, 981 bp, Arabidopsis thaliana
  misc_feature (1)..(981): Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 65 - DNA, 996 bp, Arabidopsis thaliana
  misc_feature (1)..(996): Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 66 - DNA, 1000 bp, Arabidopsis thaliana
  misc_feature (1)..(1000): Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 67 - DNA, 1000 bp, Arabidopsis thaliana
  misc_feature (1)..(1000): Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 68 - DNA, 1000 bp, Arabidopsis thaliana
  misc_feature (1)..(1000): Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 69 - DNA, 998 bp, Arabidopsis thaliana
  misc_feature (1)..(998): Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 70 - DNA, 999 bp, Arabidopsis thaliana
  misc_feature (1)..(999): Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 71 - DNA, 1000 bp, Arabidopsis thaliana
  misc_feature (1)..(1000): Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 72 - DNA, 999 bp, Arabidopsis thaliana
  misc_feature (1)..(999): Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 73 - DNA, 998 bp, Arabidopsis thaliana
  misc_feature (1)..(998): Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 74 - DNA, 1000 bp, Arabidopsis thaliana
  misc_feature (1)..(1000): Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 75 - DNA, 1514 bp, Arabidopsis thaliana
  misc_feature (1)..(1514): Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 76 - DNA, 1954 bp, Arabidopsis thaliana
  misc_feature (1)..(1954): Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 77 - DNA, 2016 bp, Arabidopsis thaliana
  misc_feature (1)..(2016): Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 78 - DNA, 667 bp, Arabidopsis thaliana
  misc_feature (1)..(667): Ceres Promoter PD1367
acagttttcttttctcatcttacaacaagtttccaggaggatagagacataaacgaagctcggattgtatcgttctttttagcttttattcacatccgaaagtcctgtagtttagattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttctcctctttcacttcatcacttggcttgtgaattcattaattcctgcgaa

SEQ ID NO: 79 - DNA, 1836 bp, Oryza sativa
  misc_feature (1)..(1836): Ceres Promoter p530c10
gcctctcgaccacgagtttagcacttgtgcaacatatatgcgtgcgatgaacatctactgatgcgccatgcgaattttagcgttcgttcatgacgcttccaacggcacagaggctgagcagcagcatgcatgcatggctcttgtgaaaacaaaaaaggttactggtaaatgacatgctgctgtagctagctagcagaatgcaaggcccatgcatatgcaatgctatgcgacaagtacagtaccagcatgtatggtagccagctaactaatctatcagcagaggcagcaagctcgtgcatggtgtgatgcacttctctccagtaatctagtggtaattttcacccaaagcgttgctcatatggacagtaattagtaatattaccaaggttcacaatcccgttacctgaccaaatactactcacgaatggtatctctggttttcgttaaaaccgttggtaaaccagcaaaaatagacaaaatttgtcaaaattttaaattttagttttttttttttaacttagccgggaaaccttgaagtttgtgctgtcgagctgtcctgggaaggacggttttggttgggattgtgaaccctggttactgcacttcatttttgaacagatattagtgcaacagacaaatgccaacgcatttttttctgtttaccggcaagctgaagcttttacgatccccatacagccgttgctgcaaacctgccaagaaagagcagcagaaacaggtgtcattttgtggtggaaagccaagtaaagtaaacagaagatggaagatagtgaggaccagggagtgaggcaggggacacatggcccacgcctccctgcacattttcgtgtataaatacaggtggatgcatcgctctcccagcatccatcggttctctgctctgttcatccatagagtttcctcctcttctcctttagtgcaaggtagagaagagcatgtgtgtgtgtgtgtgtgtgtgaactgtgaagtgcagagtgcttctgtagttctgtgttatgtccatagtgatcttgttaggattgttgctatggatgcatgatgttatggttgatctctgaattacagtagggacttttctgagatctctggattagtggggggtgctaaatttttttctggttgcatcagcttgggtttctggtattggtgtgggttcttgctctgaattttggttcagaatgtcgatttgtttgtgtttgttctctgaagttgagagtagctatgatccatccagcacagaactgcaggtcctgcctgccggctgcatatacaggacatgccattttgcaagctctgggcttatggtttctcttttggagttcttcttcttgcatgatctgtgttctctaacaaaggaagcaagatttagcaactttattcagagacaagaaaaggatctggcaaccttttgtttctgttttatcctactcgtaaagattgttatttaagcaaaaatttcccaaaagttttaaatataatttccatgatgtgccactctcatgtccttgaacctggcactcattatgggctcctcagaagtgctgtagctaatgtcactaatcttttgtatctttgttcatagtcttgtattttatgatgcttatccctttgtgctttccatgtttgatgtccaaatgtcatggcaatgtttttgacttctagtaggggttttagtacctttttgttagataagtacatccaaattctgtttatttattcaaaaatcattctgtttattcactgaaaacatttgtccattcaatggactcataaactgtctgtgtttttcaggcttgaggatccatctagaagatagca

SEQ ID NO: 80 - DNA, 3000 bp, Oryza sativa
  misc_feature (1)..(3000): Ceres Promoter pOsFIE2-2
gcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttgggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaag

SEQ ID NO: 81 - DNA, 2023 bp, Oryza sativa
  misc_feature (1)..(2023): Ceres Promoter pOsMEA
gagagcagaacatagtagccgctgttttctgggggtgcaatttgtgcaagatcgctatccttatggaccatgcaagcaccaagcaatattaagccaggtccaacagcggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgcc

SEQ ID NO: 82 - DNA, 2034 bp, Oryza sativa
  misc_feature (1)..(2034): Ceres Promoter pOsYp102
gaacgacccaaacgcgtaaatggtggtactggtttccctgctttgccgagtaccagcagccacgaagaacgttacacaatcgagtacaaaatctataagagcaagtttaatagcatagccaaatactacctctaaatcatctatagccaatttaatagttcatttattcaataattacttataaacatatactacaatcattaatatatggtcttacttcttatacacataatattttggagtccgtgttacagctggctataaatataagggattttggttggatgtggtacatcctattataatgaatctagacatgaaacctgtccaaattcatcgtgctaggatacgccacatctaaccaaaatctcttatctttagggatggagagagtaataattaaatgaagctaggtagagtttcccggtcaatacgcttgcgtgtgcttataagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgtccactcacaaaccacgcaggaaacctcagaaaatcaccgtacgcgacgcgggcccaagaaaaccccgacagaaaccgcgcagcagcaacaccaccaccggcgtcggag

SEQ ID NO: 83 - DNA, 1877 bp, Oryza sativa
  misc_feature (1)..(1877): Ceres Promoter pOsYp285
ggcccgagttaaacgatcttccacgtgtcagcgaatcctagtcgttcgatgaatctgaatctgacttgtggtggttggacggccacgtgttaaaaaagggaaacgtccgcatcacccgatgctgggacatttgcaatttcgatccagctgtagattgaccagttgttactctcttttttttaacaccatacaaacgtaatactccctctgtcccaaaatataagtattttttttaacctcggttcagtcttcgaggtgctactttgaccaataatatttataaaaataagatgttttaaataaagagagttgcatattatgatagctcgtttaatgataaacaaagtaccatcaaatttacatgattaatctttttaatttatttgctattaatagttaaaatttaaaaagtttgacttcacactgttctaaaaatacttatattttgggacggagggagtacacattagagcaggtacaatagcagactagtagccagctataaacatattttaatgagataaaagatgagagagaacagcgggctacagatctgtagccagctgcagcacggactccaagacattgtgtgtgtatgacaggtgggaccatatattaatagtacagtaagtaactattgtatgaattggctattagattagctataggtgaattgtagctagtagtgggctatactattgaacttactcttatatctctcaatatctccagaaaactaggacgatatatattgatattaacaaagtcatcatagatatctcgctatcgacatatatattacctatcactgaaaaaataattaatcataaatgcaagcacatatactacgttcaacactgaatgtaggtagattggtagacgggttccaccgcaagaaaagcattgcaccagtgaagaaagaaacatcggaatttgtatgtagtttgttgtttgatgaattcttttgattaaaaaaaactaaaatcagagttgattcagttaatggtgttgcctacgatatacttccatatcatgatatcactgtagactatgaatcatatctttaattaaaactaaatcaagaaattaagtatgagacctcaactcaatgaagaatttctagttgaaaaacattcctagtgtgcgttcggatggaggtagggatcttctctccgttcatataaaaccggatggttcattagaacatgattaattaagcaacagttaatctaaaaataaattaatattttttaagaaatttttgtatagagatcttttgaaaaaaatacattggttagaaagcatactaataaaaagagaaaaataagaacatagtactatagtagaaaatgagaacttggagtatttgagaggatgggaaataagaagattaagaagatgcgtaaagtgaacggttaacgcatgattgattaattaaatattaattattttaaatttggaaaataaattagtatgatttttaagcaacatatatatatatatatatatatatatagaaaaacatagttttagaaaatataagcgtgtaaaacgatatgcaggaacgaaacgttgagcattcaaaatttcaaattgaacatatgaatcaagagagaataaaaaaagaggccttctaggctggcatggacaattggacatgttttcaactagggtttcaagcttcgagcatccacttttgtccttgcaaactttatacggcaaggcccgtgaatctagccccccacaccaccccacccgcccgcgccgcgcggccgcctcgcctcccctcccttctcctcctctccgcccccgccgccaggccgtccacctccgccgtctcctcccccattcgcacccaaggcgctggcgcggaaggc

SEQ ID NO: 84 - DNA, 1000 bp, Arabidopsis thaliana
  misc_feature (1)..(1000): Ceres Promoter PT0565
caccaaatatagtgttatttcaatactaaaatggtgttatggttggagatgccctaaagataaacatgacgagacacgagatttattaatttcttgatcaaccataacttaataacttaatattaatttcacttaataatttccaattaagtgaatctttacttcaccaaaagttcctaacgaactcttattttctagcatcaatattaccatgaactagcatcaatactatcatgaaaaattcctacttcctatccaactcttaataacaatgctagtcttaacaatattcatcaaaaacttgatatagaccttctaacttagccacgactagtatcggtgaataccaaaattaatgtattcatgagaacttgagatttctctaatgtattcttgttactaaacaagtaacaacactcaagaaatatcatgatcaaatattttactcataaactccatatttcacattttgaaaattttaaacagcaaatcacattgaattttcgtggtaaaagtatttaaaattgaaaaatagcagctcctgatttcaatgtataaatttatctttatatggtttatgtctccaacttattttaaaaaagagagaaagagcacccaaaaggtgaccgtttgaaattcgaatttatttccgtttgaaattcgaattcaaaaaaagtaaaccgaaccgagtctcgttactgactgtcacacattgtttccctaaaagctaattaacccatacgtggcgtaatataacaggtcagtgatcaatactaaataacagacatacacctttaaaattcgtgcacgctccaaaacaaaatctacacttcaaaatcaacggtcacgatcattcctcaaatttcaaaaaattatttaacctcacttccttcgctttgtttttaaaacctctctctctttctctttctctttcgccattaaaactctgtttcctttttcagagattctcagagaagattcattttaccctaagaaaaaa

SEQ ID NO: 85 - DNA, 999 bp, Arabidopsis thaliana
  misc_feature (1)..(1000): Ceres Promoter YP0015
ttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacata

SEQ ID NO: 86 - DNA, 999 bp, Arabidopsis thaliana
  misc_feature (1)..(1000): Ceres Promoter YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 87 - DNA, 1000 bp, Arabidopsis thaliana
  misc_feature (1)..(1000): Ceres Promoter YP0093
atgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacaga

SEQ ID NO: 88 - DNA, 999 bp, Arabidopsis thaliana
  misc_feature (1)..(1000): Ceres Promoter YP0108
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaaacttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 89 - DNA, 999 bp, Arabidopsis thaliana
  misc_feature (1)..(1000): Ceres Promoter YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaac

SEQ ID NO: 90 - DNA, 999 bp, Arabidopsis thaliana
  misc_feature (1)..(1000): Ceres Promoter YP0080
aagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 91 - DNA, 3000 bp, Arabidopsis thaliana
  misc_feature (1)..(1000): Ceres Promoter PR0924
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 92 - DNA, 1000 bp, Arabidopsis thaliana
  misc_feature (1)..(1000): Ceres Promoter YP0388
agaagtattcacgcaccaaggttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatca

SEQ ID NO: 93 - DNA, 283 bp, Arabidopsis thaliana
  misc_feature (1)..(1000): Ceres Promoter PD0901
caaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagctttttaaaatatttctccacgtgcctctttgtgtttgtctatata

SEQ ID NO: 94 - DNA, 1000 bp, Arabidopsis thaliana
  misc_feature (1)..(1000): Ceres Promoter PT0623
aaagttattgacattttgaaaggaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtctatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttact

SEQ ID NO: 95 - DNA, 1349 bp, Zea mays
  misc_feature: Ceres CLONE ID no.241491
  misc_feature: Encodes the peptide sequence at SEQ ID NO 96
agcacttgtgtccggcggccttgtgttcgtgggggtgtgtggcatattagctagcggataagcggccggccgaagagcgcgcaacrcggtgagaagaagaagcaagctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacatttctgctacaatgctcaagattccaacaatggtgcactctctgaatctcagagctggtaccaggaaatatcaaaactgagggcaaaattcgaggccttgcagcgcactcagagacacttgcttggggaggaccttggcccactgagtactgtgaaggaattgcagcagctagagaaacagctagaatgtgctttgtcacaggcaagacagagaaagacgcaacttatgatggagcaagtggaagagcttcgccgaacggtattttatactagactttgtttacaatagtaaaactgatctacagcatagtaggttgatacaccgtagccagctcgggcatatatatactctatatatcgcatgcacagcagggataatcatatggacgttctttagctgaaaaactgtctgtgtaggtaggtatgcctatatatgtgtcttccgatccttgtactcttctgcacaacagattcagccgttcaccttaatgtctaaagtattcgccacattctcatggactgcgcaggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagccaataatatcccaaggagcgccgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtg

SEQ ID NO: 96 - protein, 166 aa, Zea mays
  misc_feature: Ceres CLONE ID NO.241491
  misc_feature (74)..(174): Pfam Name: K-box Pfam Description: K-box region
  misc_feature (9)..(59): Pfam Name: SRF-TF Pfam Description: SRF-type transcription factor
MGRGRVELKRIENKINRQVTFSKRRNGLLKKAYELSVLCDAEVALIIFSGRGKLYEFGSAGVTKTLERYQHFCYNAQDSNNGALSESQSWYQEISKLRAKFEALQRTQRHLLGEDLGPLSTVKELQQLEKQLECALSQARQRKTQLMMEQVEELRRTVFYTRLCLQ

SEQ ID NO: 97 - DNA, 962 bp, Oryza sativa
  misc_feature: Ceres ANNOT ID no.1241081
  misc_feature (14)..(14): n is a, c, t, g, unknown, or other
  misc_feature: Encodes the peptide sequence at SEQ ID NO 98
gcaaaagttgaggnaatggatcgatcagagatggggaggggaagggttgagctgaagcgcatcgagaacaagatcaaccggcaggtcaccttctccaagcgccgcaacggcctcctcaagaaggcgtacgagctctccgtgctctgcgacgcggaggtggcgctcatcatcttctccagccgtggcaagctgtacgaattcggtagcgccggaataaacaagacattggaaaagtacaatagttgctgttacaacgctcaaggttcaaatagtgctcttgctggtggtgaacatcagagctggtaccaagagatgtcaaggctcaagactaagcttgaatgtctccaacgctctcagaggcacatgcttggtgaagatcttggaccattgagcataaaggaactgcagcagctggagaagcaacttgagtactcactgtcacaggctcgacaacgaaagacacaaatcatgatggagcaggtcgacgatcttcgccggaaggaacgccagcttggagagctcaataagcaactgaaaaacaagctagaagctgaagccgatagcagcaactgcagatcagccatccaggattcctgggtccatggcaccgtcgtcagtggcggcagagtgctgaatgctcaaccaccaccagatattgactgtgagcctactctgcaaattgggtactatcaatttgtccgtcctgaggcggccaatccaagaagcaatggaggaggaggggatcagaacaacaactttgtgatgggatggcccctctgaagtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggt

SEQ ID NO: 98 - protein, 254 aa, Oryza sativa
  misc_feature: Ceres ANNOT ID NO.1241081
  misc_feature (14)..(64): Pfam Name: SRF-TF Pfam Description: SRF-type transcription factor
  misc_feature (79)..(179): Pfam Name: K-box Pfam Description: K-box region
  misc_feature (1)..(254): Functional Homolog of  Ceres CLONE NO.241491 at SEQ ID NO.96
MDRSEMGRGRVELKRIENKINRQVTFSKRRNGLLKKAYELSVLCDAEVALIIFSSRGKLYEFGSAGINKTLEKYNSCCYNAQGSNSALAGGEHQSWYQEMSRLKTKLECLQRSQRHMLGEDLGPLSIKELQQLEKQLEYSLSQARQRKTQIMMEQVDDLRRKERQLGELNKQLKNKLEAEADSSNCRSAIQDSWVHGTVVSGGRVLNAQPPPDIDCEPTLQIGYYQFVRPEAANPRSNGGGGDQNNNFVMGWPL

SEQ ID NO: 99 - DNA, 738 bp, Populus balsamifera subsp. trichocarpa
  misc_feature: Ceres ANNOT ID no.1524415
  misc_feature: Encodes the peptide sequence at SEQ ID NO 100
atgggaagaggaagagtggagttgaagaggatagagaacaagatcaaccgacaagttaccttctctaaaagaaggaatggcttgcttaagaaagcttatgagctttcagtgctttgtgatgctgaggttgcccttatcatcttctccagtcgtggcaagctctatgaatttggtagtgctagtgttaccaaaacccttgagcgttatcaacgctgctgctacactccacaagagaacagcattgaacgtgagacacagagctggtacctagaggcgacaaagttaaaggcaaagtatgaatcccttcaacgcactcaaaggcatttgcttggggaggatcttgggcccctgaatgtgaaagagctacaaaatcttgagaaacagcttgaaggagctcttgcacttgctaggcagagaaagcagcaggttttgacagagcaaatggaagacctgcgcaaaaaggaacgtcaccttggagacttgaacaggcatctcaaacttaagctagaagcagaaggacaaaatcttaaagccattcaagactattggaactctggtgcagcagatggaagtagcaacttccacttgcatcgtgctcaatccagccagatggactgtgatccagggcctgtcttacaaattgggtatcatcactatgttccagctgaaggatcctctgtgtctgcttcaaaaagcatgcctgacgagactaacttcttccagggatggatcctttga

SEQ ID NO: 100 - protein, 245 aa, Populus balsamifera subsp. trichocarpa
  misc_feature: Ceres ANNOT ID NO.1524415
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(245): Functional Homolog of  Ceres CLONE NO.241491 at SEQ ID NO.96 with e-value of 1.00E-73 and BLAST sequence identity of 68.5
MGRGRVELKRIENKINRQVTFSKRRNGLLKKAYELSVLCDAEVALIIFSSRGKLYEFGSASVTKTLERYQRCCYTPQENSIERETQSWYLEATKLKAKYESLQRTQRHLLGEDLGPLNVKELQNLEKQLEGALALARQRKQQVLTEQMEDLRKKERHLGDLNRHLKLKLEAEGQNLKAIQDYWNSGAADGSSNFHLHRAQSSQMDCDPGPVLQIGYHHYVPAEGSSVSASKSMPDETNFFQGWIL

SEQ ID NO: 101 - DNA, 2250 bp, Arabidopsis thaliana
  misc_feature: Ceres ANNOT ID no.158140
  misc_feature: Encodes the peptide sequence at SEQ ID NO 102
aaaccacacacacagcttcttcactgagagcttttttctagggtttctctctttgtttcttacaatgcgactcttcttcacaccgtcaatgtccaatctctccatattcttctcgattcttctcctttctcttcctcttccgtcaatcggagatctcgccgccgacaaatccgctcttctctcttttcgttccgccgtcggtggtcgtacattactctgggacgtcaagcaaacctcaccatgcaactggaccggcgtcttatgcgacggtggtcgtgttactgctcttcgtcttcccggtgaaacgctctccggtcatataccggagggtatttttggtaatttaactcagctccggacgcttagtctccgtctcaatggtcttactggttctcttcctttggatctcggaagctgctccgatcttcggcgtttgtacctgcagggtaacagattctccggtgagattccggaggttttgtttagtcttagtaaccttgttaggttgaatctagctgagaatgaatttagtggagagatctcgtcagggtttaaaaaccttactaggcttaagactctgtacctggagaataacaagctctctggctctcttttagacttggatttgtctttggatcagttcaacgtttctaataacttgttgaacggatctatacctaagagtttgcagaagtttgattctgattcgtttgtgggaacttctctctgcggcaaaccgcttgttgtctgctctaatgagggaactgtgccaagccagccaatttctgttggcaatattcccggaactgttgaaggaagtgaggagaagaagaaaaggaagaagctttctggtggagctatagctggaatagtgattggatgtgtggttggtttgtccctgattgttatgattttgatggttctctttaggaaaaaggggaacgagagaacaagggccattgaccttgcaaccatcaagcaccatgaagttgaaattcctggcgagaaagcggccgtggaagcaccggagaataggagctatgtaaatgagtactctccgtctgcagtgaaagctgtggaagtgaacagttcagggatgaagaagttagtgttttttgggaatgcgacaaaggtcttcgatcttgaggatctgttgagagcttcagcggaggttctggggaaaggaacgttcgggacagcttataaagcggtgcttgacgcggtgacattggtggctgtgaagagactgaaggatgtaacgatggcggacagagagtttaaggagaagattgaggttgttggggcgatggatcatgagaacttggtgcccttgagagcgtactattacagtggagacgagaagctgcttgtctatgacttcatgcctatgggaagcttatcagctctcttacacggaaacaaaggtgcaggccggcctccattgaactgggaagtcagatcaggcatcgcccttggagctgctcgtggcttagactatcttcactcacaagacccactgagctctcacggaaacgtcaagtcctccaatatcctcttaacaaactcccatgacgcacgagtgtctgatttcggcctggctcagcttgtaagcgcctcatccacaaccccaaaccgggccactgggtaccgtgcgccagaagtaactgacccgaggcgtgtctcacagaaagcggacgtgtacagctttggtgtggtgttgctagagttgctcaccggaaaagctccgtctaactcggtgatgaacgaggaaggaatggatttggcgaggtgggtgcattcagtggcgagagaggagtggaggaatgaggtttttgactcggagctgatgagtatcgagacagttgtctcggtggaagaagagatggcggaaatgctgcagctgggcattgactgtacagagcagcacccagacaagcggccagttatggtggaggtggtgagaaggatccaggagttgcgccaatcgggtgcagatcgggtggggtaagaccatcagatgaaaggagacttgagacatgagtctgttcgatgatctgaagcggcgacgttttcagtgtttagttttaagaatatggcgggaattagagttggggtcgttaattagatgtttttaattttggttttttttttttggtttctttcatgtgtgggcactgatgatgaggagtttcgtggtggttgtaattattagtgcttttaactttaactttattttcaatattgtttttc

SEQ ID NO: 102 - protein, 216 aa, Arabidopsis thaliana
  misc_feature: Ceres ANNOT ID NO.158140
  misc_feature (1)..(216): Functional Homolog of  Ceres CLONE NO.241491 at SEQ ID NO.96 with e-value of 1.09E-69 and BLAST sequence identity of 59.8
  misc_feature (159)..(159): Xaa is any aa, unknown, or other
  misc_feature (160)..(160): Xaa is any aa, unknown, or other
  misc_feature (161)..(161): Xaa is any aa, unknown, or other
KRIENKKNRQVTFSKRRNGLLKKAAELSVLCDAEVAAIIFSSSGKLYYYYYYYYYYPPPPPPPPPPPKRIENKINRQVTFSKRRNGLLKKAYELSVLCDAEVALIIFSSRGKLYYYYEYSSSSEEESSSSSSSSSSPPPPPPPPEFGSSSSSSSKKKKXXXDDMAINNNNNFFFFFFRRMMMMMTTTTTTTTSCCREEEEEEEEEEEEEEEEEEEE

SEQ ID NO: 103 - DNA, 723 bp, Gossypium hirsutum
  misc_feature: Ceres CLONE ID no.1932523
  misc_feature: Encodes the peptide sequence at SEQ ID NO 104
aaaaaaaaaaaaaaaaaaaaaaaaaaaaaaaaaaaaagccattgttctaaaaccaaaaaaaaatggggagaggaagagtggagctgaagaggatagaaaacaagatcaacagacaagtgaccttctctaagagaagaaatggtttgcttaaaaaagcttatgagctttctgttctttgtgatgctgaggttgctcttatcatcttctctagtcgtggcaagctctacgagtttggcagttcaggtatgagcaagacccttgagcgataccagcgttgctgctttactcctcaagacaacagccttgaacgcgaaacacagaattggtaccaagaggtaaccaagttaaaggcaaaatatgaagcactgcaacgcactcaaaggcatttgcttggagaagatcttggaccattgaatgttaaggagctgcaaaaccttgagaaacagcttgaaggagctcttgcactggctagacaaaggaagacacagatcatgatagaacaaatggaagacctccgtaaaaaggagcgtgagcttggagaccttaacaaacagctgaaaatcaagctagaggcagaaggacaaaacctcaaaacaatccaaggtttatggagtagtggtgcagcagctgaaactagcaactttcctctgcatccttctcacccacatcctatgggattgtgatcatgaacctgttctgcaaatagggtaccatcactttgtt

SEQ ID NO: 104 - protein, 243 aa, Gossypium hirsutum
  misc_feature: Ceres CLONE ID NO.1932523
  misc_feature (1)..(243): Functional Homolog of  Ceres CLONE NO.241491 at SEQ ID NO.96 with e-value of 4.59E-78 and BLAST sequence identity of 70.9
MGRGRVELKRIENKINRQVTFSKRRNGLLKKAYELSVLCDAEVALIIFSSRGKLYEFGSSGMSKTLERYQRCCFTPQDNSLERETQNWYQEVTKLKAKYEALQRTQRHLLGEDLGPLNVKELQNLEKQLEGALALARQRKTQIMIEQMEDLRKKERELGDLNKQLKIKLEAEGQNLKTIQGLWSSGAAAETSNFPLHPSHPHPMDCDHEPVLQIGYHHFVQAEGSSVPKSMAGETNFIHGWVI

SEQ ID NO: 105 - protein, 258 aa, Triticum aestivum
  misc_feature: Public GI ID NO.3688591
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(258): Functional Homolog of  Ceres CLONE NO.241491 at SEQ ID NO.96 with e-value of 1.70E-101 and BLAST sequence identity of 84.8
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSLARQRKTQLMMEQVEELRRKERQLGDINRQLKHKLDAEGSNSNNYRAMQQISWAAGTVVDEGAAAYHMQQQQQHPNHSAAMDCEPTLQIGYHHQFAAPDQAANNIPRSSAPGGENNFMLGWVL

SEQ ID NO: 106 - protein, 263 aa, Hordeum vulgare subsp. vulgare
  misc_feature: Public GI ID NO.44888603
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(263): Functional Homolog of  Ceres CLONE NO.241491 at SEQ ID NO.96 with e-value of 4.50E-103 and BLAST sequence identity of 85.2
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSQARQRKTQLMMEQVEELRRKERQLGDINRQLKHKLDAEGSNSNNYRTMQQITWAAGTVVDEGAAAYHMQQQQQQQQQHPNHSAAMDCEPTLQIGYPHHQFAAPDQVANNIPRSSAPGGENNFMLGWVL

SEQ ID NO: 107 - protein, 249 aa, Dendrocalamus latiflorus
  misc_feature: Public GI ID NO.47681319
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.241491 at SEQ ID NO.96 with e-value of 1.30E-103 and BLAST sequence identity of 87.0
MGRGKVELKRIENKINRQVTFSKRRNGLLKKAYELSVLCDAEVALIIFSSRGKLYEFGSAGISKTLERYQHCCYNAQDNNALSETQIWYQEMSKLRAKFEALQRTQRHLLGEDLGPLSVKELQQLEKQLECALSQARQRKTQLMMEQVEELRKKERQLGEINRQLKHKLEAEGSSNYRAMHRASWAPGTVVDEGAAYHEQQPPHSAALDCEPPTLQIGYPHQFMPPEAANIPRSAPAGGENNFMLGWVL

SEQ ID NO: 108 - protein, 250 aa, Oryza sativa subsp. japonica
  misc_feature: Public GI ID NO.50251892
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.241491 at SEQ ID NO.96
MGRGRVELKRIENKINRQVTFSKRRNGLLKKAYELSVLCDAEVALIIFSSRGKLYEFGSAGITKTLERYQHCCYNAQDSNNALSETQSWYHEMSKLKAKFEALQRTQRHLLGEDLGPLSVKELQQLEKQLECALSQARQRKTQLMMEQVEELRRKERQLGEINRQLKHKLEVEGSTSNYRAMQQASWAQGAVVENGAAYVQPPPHSAAMDSEPTLQIGYPHQFVPAEANTIQRSTAPAGAENNFMLGWVL

SEQ ID NO: 109 - protein, 255 aa, Zea mays
  misc_feature: Public GI ID NO.939779
  misc_feature (1)..(255): Functional Homolog of  Ceres CLONE NO.241491 at SEQ ID NO.96 with e-value of 4.50E-119 and BLAST sequence identity of 92.8
MGRGRVELKRIENKINRQVTFSKRRNGLLKKAYELSVLCDAEVALIIFSSRGKLYEFGSAGITKTLERYQHCCYNAQDSNGALSETQSWYQEMSKLRAKFEALQRTQRHLLGEELGPLSVKELQQLEKQLECALSQARQRKTQLMMEQVEELRRKERHLGEMNRQLKHKLEAEGCSNYRTLQHAAWPAPGSTMVEHDGATYHVHPTTAQSVAMDCEPTLQIGYPPHHQFLPSEAANNIPRSPPGGENNFMLGWVL

SEQ ID NO: 110 - protein, 255 aa, Zea mays
  misc_feature: Public GI ID NO.939781
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(255): Functional Homolog of  Ceres CLONE NO.241491 at SEQ ID NO.96 with e-value of 9.60E-133 and BLAST sequence identity of 98.0
MGRGRVELKRIENKINRQVTFSKRRNGLLKKAYELSVLCDAEVALIIFSGRGKLYEFGSAGVTKTLERYQHCCYNAQDSNNSALSESQSWYQEMSKLRAKFEALQRTQRHLLGEDLGPLSVKELQQLEKQLECALSQARQRKTQVMMEQVEELRRTERHLGEMNRQLKHKLEAEGCSNYTTLQHAACWPAPGGTIVEHDGATYQVHPPAHSVAMDCEPTLQIGYPHHQFPPPEAVNNIPRSAATGENNFMLGWVL

SEQ ID NO: 111 - protein, 242 aa, Pinus radiata
  misc_feature: Public GI ID NO.1206005
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.241491 at SEQ ID NO.96 with e-value of 5.19E-70 and BLAST sequence identity of 67.6
MGRGRVELKRIENKINRQVTFSKRRNGLLKKAYELSVLCDAEVALIIFSSRGKLYEFGSAGMLKTLERYQKCSYVLQDATVSDREAQNWHQEVGKLKARVELLQRSQRHLLGEDLGPLSIKELQQLERQLEVALTHVRSRKTQVMLEMMDELRRKERILQEVNKSLRKKLQEAEGQAFNAMQPPPHAWDSHAVANNAYAMQHPSNAVDCEPTLQIGYQYAPPESSMPRHEQAQNNYMQGWMV

SEQ ID NO: 112 - protein, 242 aa, Pinus resinosa
  misc_feature: Public GI ID NO.1702951
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.241491 at SEQ ID NO.96 with e-value of 1.80E-69 and BLAST sequence identity of 67.2
MGRGRVELKRIENKINRQVTFSKRRNGLLKKAYELSVLCDAEVALIIFSSRGKLYEFGSAGMLKTLERYQKCSYVLQDATVSDREAQNWHQEVGKLKARVELLQRSQRHLLGEDLGPLSIKELQQLERQLEVALTHVRSRKTQVMLEMMDELRRKERILQEVNKSLRKKLQEAEGQAFNAMQPPPHAWDSHAVANNAYAMQHPSNAVDCEPTLQTGYQYAPPESSMPRHEQAQNNYMQGWMV

SEQ ID NO: 113 - protein, 261 aa, Pinus radiata
  misc_feature: Public GI ID NO.2160701
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(261): Functional Homolog of  Ceres CLONE NO.241491 at SEQ ID NO.96 with e-value of 5.09E-63 and BLAST sequence identity of 60.8
MGRGRVQLRRIENKINRQVTFSKRRNGLLKKAYELSVLCDAEVALIIFSTRGKLYEFASSSMNKTLERYEKCSYAMQDTTGVSDREAQNWHQEVTKLKGKVELLQRSQRHLLGEDLGPLNVKELQQLERQLEVALTHLRSRKTQVMLDQIEELRQRERLLHEVNKSLQKKLSETEGRDVITGIEQTSNTNTGTNGPWDSSITNTAYALSHPQQDSNSSLHHVDCEPTLQIGYQPVAPESIVPPHQPPHNQTPNQYMQGWWV

SEQ ID NO: 114 - protein, 252 aa, Arabidopsis thaliana
  misc_feature: Public GI ID NO.2979564
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491 at SEQ ID NO.96
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 115 - protein, 243 aa, Malus x domestica
  misc_feature: Public GI ID NO.3646340
  misc_feature (69)..(171): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.241491 at SEQ ID NO.96 with e-value of 7.69E-76 and BLAST sequence identity of 68.8
MGRGRVELKRIENKINRQVTFSKRRNGLLKKAYELSVLCDAEVGLIIFSSRGKLYEFASAGMSKTLERYQRCSFTPPENSIERETQSWYQEVTKLKAKYESLQRTQRHLLGEDLGPLSVKELQNLEKQLEGALAQTRQRKTQLMIEQMEDLRKKERHLGDLNKQLRVKLEAEGQNLNVIQNMWSSDAAAGSSNFSLHSSQTNPMDCTPEPVIQMGYHQYHPAEGSSIPRSLTGETNFIQGWVL

SEQ ID NO: 116 - protein, 253 aa, Gnetum gnemon
  misc_feature: Public GI ID NO.5019456
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(253): Functional Homolog of  Ceres CLONE NO.241491 at SEQ ID NO.96 with e-value of 7.70E-60 and BLAST sequence identity of 56.0
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRSLMGEDLGPLNIKELQSLEQQLEVALGHVRNRKTQLLIQTIDELRDKERTLQEVNKSLQKKLSETEGRNVIPALPHAPNGSGEWESSTLTTTTYALQTQQTSNIHHVDCEPTLHIGPYHQAVHHEAITAPPATHSEPHNQYIWWV

SEQ ID NO: 117 - protein, 254 aa, Gnetum gnemon
  misc_feature: Public GI ID NO.5019460
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(254): Functional Homolog of  Ceres CLONE NO.241491 at SEQ ID NO.96 with e-value of 2.49E-63 and BLAST sequence identity of 63.9
MGRGRVELKRIENKINRQVTFSKRRNGLLKKAYELSVLCDAEVALIIFSSRGKLYEFGSAGTLKTLERYQKCSYALQESNNSDRDAQTWHHEVSKLKTKVEILQRSQRHLLGEDLGPLSIRELQTLERQIEVALTQVRARKTQVMMDMMDDLKKKERLLQEVNKSLRKKLDETEGQVYSNAQLQAAPPPEWDSNAIANPVYALPPTPQNAVDCEPTCKLGIMLLLSQAFPGMIILRTTTYRGGWSNLIPDANNQ

SEQ ID NO: 118 - protein, 252 aa, Gnetum parvifolium
  misc_feature: Public GI ID NO.6092009
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491 at SEQ ID NO.96 with e-value of 2.29E-60 and BLAST sequence identity of 54.1
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRNLMGEDLGPLNIKELQSLEQQLEVALGHVRNRKTQLLIQTIDELRDKERTLQEVNKSLQKKLSETEGRNVIPALPHATTGSGEWESSTLTTTYALQTQQPSGIHHVDCEPTLHIGPYHQAVHHEAIPGPPATHSEPHNQYIWWV

SEQ ID NO: 119 - protein, 253 aa, Petunia x hybrida
  misc_feature: Public GI ID NO.7544096
  misc_feature (69)..(171): Pfam Name: K-box Pfam Description: K-box region
  misc_feature (9)..(59): Pfam Name: SRF-TF Pfam Description: SRF-type transcription factor
  misc_feature (1)..(253): Functional Homolog of  Ceres CLONE NO.241491 at SEQ ID NO.96 with e-value of 2.70E-73 and BLAST sequence identity of 68.6
MGRGRVELKRIENKINRQVTFSKRRNGLLKKAYELSVLCDAEVALIIFSSRGKLYEFGNAGITKTLERYQRCCLNPQDNCGERETQSWYQEVSKLKGKFEALQRTQRHLLGEDLGPLSVKELQNLEKQLEGALAQARQRKTQIMMEQMEELRRKERHLGDVNKQLKVKVSLELSSLEAEGQAGLNRALPFLWTSNALEAGNSNFPVHHSQSNPMDCGPDPVLQYRDHHYMAADGPSGSRSMAVETNIMQGWGL

SEQ ID NO: 120 - protein, 259 aa, Poa annua
  misc_feature: Public GI ID NO.13958339
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(259): Functional Homolog of  Ceres CLONE NO.241491 at SEQ ID NO.96 with e-value of 1.70E-101 and BLAST sequence identity of 85.2
MGRGRVELKRIENKINRQVTFSKRRNGLLKKAYELSVLCDAEVALIIFSSRGKLYEFGSAGTTKTLERYQHCCYNAQDSNSALSETQSWYQEMSKLKAKFEALQRTQRHLLGEDLGPLSVKELQQLEKQLECSLSQARQRKTQLMVEQVEELRRKERQLGEINRQLKHKLDAEGSSSNNYRAMQQLTWAAGTVVDEGAAAYHMQHQQQQQPNHSAAMDCEPTLQIGYPHQFAAPEQAANNIPRSSGQGGENNFMLGWVL

SEQ ID NO: 121 - protein, 244 aa, Vitis vinifera
  misc_feature: Public GI ID NO.20385586
  misc_feature (84)..(171): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.241491 at SEQ ID NO.96 with e-value of 9.19E-80 and BLAST sequence identity of 73.1
MGRGRVELKRIENKINRQVTFSKRRNGLLKKAYELSVLCDAEVALIIFSSRGKLYEFGSAGTTKTLERYQRVCYTPQDNNMECETQSWYQEVSKLKAKYESLQRTQRHLLGEDLGPLSVKELQNLEKQLEGALAQARQRKTQMMIEQMEDLRRKERQLGDLNKQLKLKLEAEGQSLKAIQGSWNPSTATAGNSSFPVHPSQSNPMDCEPEPILQIGYHHYVPAEGPSVSKSMAGESNFIQGWVL

SEQ ID NO: 122 - protein, 259 aa, Brassica oleracea var. botrytis
  misc_feature: Public GI ID NO.23304692
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(259): Functional Homolog of  Ceres CLONE NO.241491 at SEQ ID NO.96 with e-value of 1.29E-66 and BLAST sequence identity of 58.6
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGLVLVYIRFQQHYYVQGEGSSVPKSNVACETNFVQDWFL

SEQ ID NO: 123 - protein, 252 aa, Brassica oleracea var. botrytis
  misc_feature: Public GI ID NO.23304710
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491 at SEQ ID NO.96 with e-value of 7.59E-69 and BLAST sequence identity of 58.6
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGFQQHYYVQGEGSSVPKSNVACETNFVQDWFL

SEQ ID NO: 124 - protein, 250 aa, Chrysanthemum x morifolium
  misc_feature: Public GI ID NO.27804371
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.241491 at SEQ ID NO.96 with e-value of 7.59E-69 and BLAST sequence identity of 67.9
MGRGRVELKRIENKINRQVTFSKRRNGLLKKAYELSVLCDAEVGLIIFSSRDKLYEFGSVGVMKTLERYQRCCFNPQDNNNERETQSWYQEVSKLKAKFESLQRTQRHLLGEDLGPLSVKELHNLEKQLEGALTQARQRKTQILVEQMEELRCKERELGDMNKHLKIKVSHELSTFETEGQGYRTHQLPCPWNSSNNNTFLMHPSQSNPMGCQQEQPILQIGDNQFMQGEGSSGQRNMVDETNIHGNWVI

SEQ ID NO: 125 - protein, 260 aa, Lolium perenne
  misc_feature: Public GI ID NO.28630959
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(260): Functional Homolog of  Ceres CLONE NO.241491 at SEQ ID NO.96 with e-value of 1.19E-100 and BLAST sequence identity of 84.0
MGRGRVELKRIENKINRQVTFSKRRNGLLKKAYELSVLCDAEVALIIFSSRGKLYEFGSAGTTKTLERYQHCCYNAQDSSSALSETQSWYQEMSKLKAKFEALQRTQRHLLGEDLGPLSVKELQQLEKQLECSLSQARQRKTQLMMEQVEELRRKERQLGEINRQLKHKLDAEGSSSNSFRAMQQITWAAGTVVDEGAGAYHMHHQQQPNHSAAMDCEPTLQIGYPHQFAAAEQAANNIPRSSAPGGENNFMLGWVLGAN

SEQ ID NO: 126 - protein, 243 aa, Agapanthus praecox
  misc_feature: Public GI ID NO.29467050
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.241491 at SEQ ID NO.96 with e-value of 1.79E-83 and BLAST sequence identity of 72.0
MGRGRVELKRIENKINRQVTFSKRRNGLLKKAYELSVLCDAEVALIVFSSRGKLYEFGSAGTSKTLERYQRCCYTSQDATIADREKQNWYQEVARLKAKFESLQSAQRHLLGEDLGPLSVKELQQLERQLEASLSQARQRKTQIMFDQMEELRKKEHHLGEINKQLKTKLEAEGENLRAIQGSWESDATNVGGGNVFSMHPSHSSAMECEPTLQIGYHQLVQPEGSLPRNSGGENNFMLGWVL

SEQ ID NO: 127 - protein, 241 aa, Asparagus officinalis
  misc_feature: Public GI ID NO.34979582
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.241491 at SEQ ID NO.96 with e-value of 4.49E-87 and BLAST sequence identity of 77.1
MGRGRVELKRIENKINRQVTFSKRRNGLLKKAYELSVLCDAEVALIIFSSRGKLYEFGSAGTSKTLERYQRCCYTSQDAAIASHETQSWYQEVSKLKAKFESLQRSQRHLLGEDLGPLSVKELQQLERQLESALSQARQRKTQIMLDQMEELRKKERHLGEINKQLKAKLEAEGASFRAIQGSWESEAGVGGNAFSMHPSQSSAMDCEPTLQIGYHHLVQPEAALPRSSGGENNFMLGWVL

SEQ ID NO: 128 - protein, 249 aa, Dendrocalamus latiflorus
  misc_feature: Public GI ID NO.47681321
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.241491 at SEQ ID NO.96 with e-value of 9.39E-103 and BLAST sequence identity of 86.6
MGRGNVELKRIENKINRQVTFSKRRNGLLKKAYELSVLCDAEVALIIFSSRGKLYEFGSAGISKTLERYQHCCYNAQDNNALSETQIWYQEMPKLRAKFEALQRTQRHLLGEDLGPLSVKELQQLEKQLECALSQARQRKTQLMMEQVEELRKKERQLGEINRQLKHKLEAEGSSNYRAMHQASWAPGTVVDEGAAYHVQQPPHSAALDCEPPTLQIGYPHQFMPPEAANIPGSAPAGGENNFMLGWVL

SEQ ID NO: 129 - protein, 247 aa, Gerbera hybrida
  misc_feature: Public GI ID NO.50470538
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(247): Functional Homolog of  Ceres CLONE NO.241491 at SEQ ID NO.96 with e-value of 2.70E-73 and BLAST sequence identity of 69.2
MGRGRVELKRIENKINRQVTFSKRRNGLLKKAYELSVLCDAEVGLIIFSSRDKLYEFGSVGVMKTLERYQRCCFNPQDNNNERETQSWYQEVSKLKAKFESLQRTQRHLLGEDLGPLSVKELHNLEKQLEGALTQARQRKTQIMVEQMEELRRKERELGDMNKHLKIKVSHELSTFDAEGQGYRAQLPCPWNSGTNNTFTMHPSQSNPMDCQQEPILQIGYNQFMHGEGSSVQRNMVGENGIHGWVL

SEQ ID NO: 130 - protein, 242 aa, Hyacinthus orientalis
  misc_feature: Public GI ID NO.50919528
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.241491 at SEQ ID NO.96 with e-value of 5.29E-84 and BLAST sequence identity of 74.6
MGRGRVELKRIENKINRQVTFSKRRNGLLKKAYELSVLCDAEVALIVFSSRGKLYEFGSAGTGKTLERYQRCCYTSQDASIADREAQSWYQEVSKLKAKFESLQRSQRHLLGEDLGPLSVKELQQLERQMESALSQARQRKQTQIMLDQMEELRKKERHLGEINKHLKSRLEAEGATFRAIQGSWESTAAIQGNAFSVHPSQSRAMDCEPTLQIGYHHLVQPEEAIPRNTVGENNFMLGWVL

SEQ ID NO: 131 - protein, 241 aa, Elaeis guineensis
  misc_feature: Public GI ID NO.58201615
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.241491 at SEQ ID NO.96 with e-value of 3.80E-83 and BLAST sequence identity of 73.4
MGRGRVELKRIENKINRQVTFSKRRSGLLKKAYELSVLCDAEIALIIFSSRGKLYEFGSVGTSKTLERYQRCCYTSQDSNFADQETQNWYQEMAKLKAKFESLQRSQRHLLGEDLGPLTVKELQQLERQLESALSQARQRKAQIMLDQMEELRKKERHLGEINKQLKDRLDAESASFRAIQGSWASDGVVTNNAFSLQPSQSNDMDCEPTLQIGFPQLVPPEAAITRNTGGENNFMLGWVL

SEQ ID NO: 132 - protein, 244 aa, Hordeum vulgare subsp. vulgare
  misc_feature: Public GI ID NO.58866604
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.241491 at SEQ ID NO.96
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRARKNQLMHESISELQKKERSLQEENKVLQKELVEKQKAQAAQQDQTQPQTSSSSSSFMMRDAPPVADTSNHPAAAGERAEDVAVQPQVPLRTALPLWMVSHING

SEQ ID NO: 133 - protein, 252 aa, Ginkgo biloba
  misc_feature: Public GI ID NO.62122341
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491 at SEQ ID NO.96 with e-value of 1.19E-63 and BLAST sequence identity of 58.6
MGRGRVQLRRIENKINRQVTFSKRRNGLLKKAYELSVLCDAEVALIVFSTRGKLYEFASSSMNKTLERYEKCSYAVQDTNVSNREAQNWHQEVTKLKSKVELLQQSQRHLLGEDLGPLSVKELQQLERQLEIALNHVRSRKSQVMMDLIDELRKKERLLQEVNKSLHKKLSESEGRNATHDMRHPTDDNGPWNPSVNGGYALPSTQQNTNLHPVDCEPTLQIGYQSVPRESIEPPQEQTHNQPQDNYTGWWV

SEQ ID NO: 134 - protein, 243 aa, Ginkgo biloba
  misc_feature: Public GI ID NO.62122355
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.241491 at SEQ ID NO.96 with e-value of 2.40E-72 and BLAST sequence identity of 66.5
MGRGRVELKRIENKINRQVTFSKRRNGLLKKAYELSVLCDAEVALIIFSSRGKVYEFGSAGMTKTLERYQKCSYVLQDVNVSDREAQNWHQEVGKLKAKVELLQRSQRHLLGEDLGPLSVKELQQLERQLEVALTHVRSRKTQVMLDLMDELRKKERLLQEVNKSLRKKLSEAEEQRAFSAMQDPGSWDSNAVANNAYAMPPNQSNAVDCEPTLQIGYQYAPPETSMPRADQTENNYMQGWMV

SEQ ID NO: 135 - protein, 241 aa, Amborella trichopoda
  misc_feature: Public GI ID NO.63014399
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.241491 at SEQ ID NO.96 with e-value of 2.10E-80 and BLAST sequence identity of 71.3
MGRGRVELKRIENKINRQVTFSKRRNGLLKKAYELSVLCDAEVGLIIFSSRGKLYEFGSAGLSKTLERYQRCCYTPQDNSATDRETQNWSQELSKLKAKYETLQRSQRHLLGEDLGPLSVKELQQLERQLEVALSQARQRKTQILMDQMEELRRKERRLGDINKQLKSKLESDGQGSFRGIQGTWESGTVVGNNAFAVNPSHANPIDCEPTLQIGYHHFVSPESIPRTGPAESNFVQGWVL

SEQ ID NO: 136 - protein, 249 aa, Oryza sativa
  misc_feature: Public GI ID NO.75233139
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.241491 at SEQ ID NO.96 with e-value of 6.30E-81 and BLAST sequence identity of 72.2
MGRGRVELKRIENKINRQVTFSKRRNGLLKKAYELSVLCDAEVALIIFSSRGKLYEFGSAGINKTLEKYNSCCYNAQGSNSALAGGEHQSWYQEMSRLKTKLECLQRSQRHMLGEDLGPLSIKELQQLEKQLEYSLSQARQRKTQIMMEQVDDLRRKERQLGELNKQLKNKLEAEADSSNCRSAIQDSWVHGTVVSGGRVLNAQPPPDIDCEPTLQIGYYQFVRPEAANPRSNGGGGDQNNNFVMGWPL

SEQ ID NO: 137 - protein, 247 aa, Momordica charantia
  misc_feature: Public GI ID NO.90995184
  misc_feature (82)..(171): Pfam Name: K-box Pfam Description: K-box region
  misc_feature (9)..(59): Pfam Name: SRF-TF Pfam Description: SRF-type transcription factor
  misc_feature (1)..(247): Functional Homolog of  Ceres CLONE NO.241491 at SEQ ID NO.96 with e-value of 2.40E-72 and BLAST sequence identity of 67.3
MGRGRVELKRIENKINRQVTFSKRRNGLLKKAYELSVLCDAEVALIIFSSRGKLYEFGSAGTTKTLERYQRCCFSPQDNHIERQTQSWFQEISKLKVKYESLCRTQRHLLGEDLGPLSVKELQNLEKQLEAALAQARQRKTQMMIDQMEALRRKERQLGDLNKELRLKLEAEGQNLKAIQSFWSSSSAAAGHGNDFPLHHSQASPIECQHEQPVLQIGYQNYFSAEGPSVRKSMTTCETNFIQGWVI

SEQ ID NO: 138 - protein, 259 aa, Triticum aestivum
  misc_feature: Public GI ID NO.95981958
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(259): Functional Homolog of  Ceres CLONE NO.241491 at SEQ ID NO.96 with e-value of 2.60E-100 and BLAST sequence identity of 82.8
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSLARQRKTQLMMEQVEELRRKERQLGDINRQLKHKLDAEGSNSNNYRAMQQITWAAGTVVDEGAAAYHMQQQQQQHPNHSAAMDCEPTLRIGYPHQFAAPDQAANNIPRSSAPGGENDFMLGWVL

SEQ ID NO: 139 - DNA, 1305 bp, Zea mays
  misc_feature: Ceres CLONE ID no.246416
  misc_feature: Encodes the peptide sequence at SEQ ID NO 140
aaaaaaccgccccctcccttcctcttctcctagctctcttgcctgcgcaccactcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 140 - protein, 251 aa, Zea mays
  misc_feature: Ceres CLONE ID NO.246416
  misc_feature (76)..(173): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 141 - DNA, 974 bp, Oryza sativa
  misc_feature: Ceres ANNOT ID no.1250906
  misc_feature: Encodes the peptide sequence at SEQ ID NO 142
catcttccccgagctctccaccctccacccgccaccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccagtatggaagggatccttgaacgctaccagcgttactcgtttgatgaaagagccgtactggagccaaatactgaggaccaggaaaactggggtgatgaatatggaattttgaagtccaaactggatgcacttcagaagagccaaaggcaactcttaggtgaacaattggacacactaacaataaaagaactccagcaattggaacatcaactggaatattctctgaagcatataagatcaaaaaagaatcagcttctgtttgaatcaatttctgagcttcagaagaaggaaaagtcacttaaaaaccagaataatgttctgcaaaagctcatggagacagaaaaggagaaaaacaatgctataataaacactaaccgggaggagcaaaatggagcaacaccaagcacatcatcaccaacaccagtgacggctccagatcccatcccgacaacaaataacagtcaaagccaaccaagaggatcaggggagtcagaagctcaaccgtctccggcacaagcaggcaacagcaagcttccgccatggatgctccggacaagtcacacatgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgt

SEQ ID NO: 142 - protein, 249 aa, Oryza sativa
  misc_feature: Ceres ANNOT ID NO.1250906
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.246416 at SEQ ID NO.140
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 143 - DNA, 726 bp, Populus balsamifera subsp. trichocarpa
  misc_feature: Ceres ANNOT ID no.1511886
  misc_feature: Encodes the peptide sequence at SEQ ID NO 144
atgggaagaggtagggttcagttgaagagaatagagaacaagatcaaccggcaggttacattttccaaaagaagaactggattgttgaagaaagctcatgaaatctcagtcctatgtgatgccgaggttgccttgatcgtcttctctcataaagggaagctctttgaatactccaccaatgcttgcatggaaaagatacttgaacgccacgagaggtattcttatgcagagaggcaattagtcgcaactgatcttgattcgcaggggaactggaccctagagtataacaggctcaaggcaaaggttgaacttctacagagaaaccacaggcactatttgggggaagatctggactccgtgagtctcaaagagcttcaaaacttggagcaacagattgataccgcccttaaactcattcgggaaagaaaaaaccatctgatgtatcagtcgatttctgagctgcagataaaggagaaggcaattaaagagcaaaataacatgttagtgaagcagatcaaggagaaggagaaagcactggcacagccggcactctgggatcagcaagatcatggccctaatgcttcctcattccttttaccacagccgccactgccttgtttaaacatcagttaccaggaagaagatccagaagcgaggaggaattatgaacttgacctcacgctggaaccaatttattcgtgtcaccttggatgctttggaacatga

SEQ ID NO: 144 - protein, 241 aa, Populus balsamifera subsp. trichocarpa
  misc_feature: Ceres ANNOT ID NO.1511886
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.246416 at SEQ ID NO.140
MGRGRVQLKRIENKINRQVTFSKRRTGLLKKAHEISVLCDAEVALIVFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKEKAIKEQNNMLVKQIKEKEKALAQPALWDQQDHGPNASSFLLPQPPLPCLNISYQEEDPEARRNYELDLTLEPIYSCHLGCFGT

SEQ ID NO: 145 - DNA, 747 bp, Populus balsamifera subsp. trichocarpa
  misc_feature: Ceres ANNOT ID no.1517635
  misc_feature: Encodes the peptide sequence at SEQ ID NO 146
atgggaagaggtagggttcagttgaagagaatagagaacaagatcaaccggcaggtaacattttccaaaaggagaactggattgttgaagaaagctaatgaaatctcagtcctgtgtgacgctgaggttgctttgattgtcttctctcacaaagggaagctctttgaatactccacagatgattccatggaaaagatacttgaacgctacgagagatattcttatgcagagaggcaactagttgccactgatcttgattcacaggggaactggaccctggagtataacaggctcaaggcaaaggttgaacttctacagagaaaccataggaactatttgggggaggatctagactccatgagtctcaaagagctacagaacttagagcaacagattgataccgcccttaaacacattcgggcgagaaaaaaccatctgatgagtcagtcgatttctgagctgcagagaaaggagaaggcaattcaagtgcaaaacaacatgttagtgaagcagatcaaggagaaggagaagaatgataaagcgctggcacagccggcattctgggatctgcaagatcatggccctaatgcttcctcattccttttatcacagccggcaggcctgccactgccttgcttaaacatcggtggcagtcaccaggaagaagctcctgaagcgaggaggaatgagcttggccatacgctggaaccaatttattcttttcaccttggaggttacggagcatga

SEQ ID NO: 146 - protein, 248 aa, Populus balsamifera subsp. trichocarpa
  misc_feature: Ceres ANNOT ID NO.1517635
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416 at SEQ ID NO.140
MGRGRVQLKRIENKINRQVTFSKRRTGLLKKANEISVLCDAEVALIVFSHKGKLFEYSTDDSMEKILERYERYSYAERQLVATDLDSQGNWTLEYNRLKAKVELLQRNHRNYLGEDLDSMSLKELQNLEQQIDTALKHIRARKNHLMSQSISELQRKEKAIQVQNNMLVKQIKEKEKNDKALAQPAFWDLQDHGPNASSFLLSQPAGLPLPCLNIGGSHQEEAPEARRNELGHTLEPIYSFHLGGYGA

SEQ ID NO: 147 - DNA, 1165 bp, Arabidopsis thaliana
  misc_feature: Ceres CLONE ID no.39890
  misc_feature: Ceres LOCUS ID At1g69120
  misc_feature: Encodes the peptide sequence at SEQ ID NO 148
aagtctttttataaaggaaagaaagaaaaactttcctaattggttcataccaaagtctgagctcttctttatatctctcttgtagtttcttattgggggtctttgttttgtttggttcttttagagtaagaagtttcttaaaaaaggatcaaaaatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataaggggaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcataaccaaggccacaatatgcctccccctctgccaccgcagcagcaccaaatccagcatccttacatgctctctcatcagccatctccttttctcaacatgggtggtctgtatcaagaagatgatccaatggcaatgaggaggaatgatctcgaactgactcttgaacccgtttacaactgcaaccttggctgcttcgccgcatgaagcatttccatatatatatttgtaatcgtcaacaataaaaacagtttgccacatacatataaatagtggctaggctcttttcatccaattaatatattttggcaaatgttcgatgttcttatatcatcatatataaattagcaggctcctttcttcttttgtaatttgataagtttatttgcttcaatatggagcaaaattgtaatatatttgaaggtcagagagaatgaacgtgaactt

SEQ ID NO: 148 - protein, 256 aa, Arabidopsis thaliana
  misc_feature: Ceres CLONE ID NO.39890
  misc_feature: Ceres LOCUS ID At1g69120
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQHNQGHNMPPPLPPQQHQIQHPYMLSHQPSPFLNMGGLYQEDDPMAMRRNDLELTLEPVYNCNLGCFAA

SEQ ID NO: 149 - DNA, 1224 bp, Glycine max
  misc_feature: Ceres CLONE ID no.467075
  misc_feature: Encodes the peptide sequence at SEQ ID NO 150
gacagaaagaagaaccaccaagaaagaagcataggggaaaatacatcgatagagagaaattgaagggtgctacgtccttctattgtattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcaagaaagcacatgagatctctgtgcattgtgatgctgaagtggccctcatagtcttctccaccaaaggcaaactctttgagtactccagcgatccctgtatggaaaaaattcttgaacggtatgagaggtattcatatgcagagaggcagcttgttgcaagtgatcaaccactaactgaaaattggactctggaacatgcaaagctgaaagcaaggttggaagtcctacagaaaaatcaaagggtttgcctgttattttgcaggaattttatgggacaagatttggagggcctaagtatcaaagagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgatcagttggaatatcaacgatatgtaatatgtctgtgactaccacatttcaaggatgcttagtaaattatatggtatggcctgtctatacaggcctacaatacatatatagtgtcaattaaaaaaaaaaaaaaaaaa

SEQ ID NO: 150 - protein, 251 aa, Glycine max
  misc_feature: Ceres CLONE ID NO.467075
  misc_feature (75)..(181): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRSGLLKKAHEISVHCDAEVALIVFSTKGKLFEYSSDPCMEKILERYERYSYAERQLVASDQPLTENWTLEHAKLKARLEVLQKNQRVCLLFCRNFMGQDLEGLSIKELQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 151 - DNA, 1241 bp, Glycine max
  misc_feature: Ceres CLONE ID no.480529
  misc_feature: Encodes the peptide sequence at SEQ ID NO 152
tattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcamgaaagcacatgagatctctgtgcmttgtgatgctgaagtggccctcatagtcttctccaccaaaggcaaactctttgagtactccagcgatccctgtatggaaaaaattcttgaacggtatgagaggtattcatatgcasagaggcagcttgttgcaagtgatcaaccactaactgaaaattggactctggaacatgcaaagctgaaagcaaggttggaagtcctacagaaaaatcaaaggaattttatggsacaagatttggagggcctaagtwtcaaasagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgatcagttggaatatcaacgatatgtaatatgtctgtgactaccacatttcaaggatgcttagtaaattatatggtatggcctgtctatacaggcctacaatacatatatagtgtcaattatgtatgtttggttcttatcaaaagtttaagttgtgctagaaactacgatattgggcgatgttagatccctcaaaatctatgattttttacaacagaaatattaaattttgtatgaactaatggttttatctaagtgttac

SEQ ID NO: 152 - protein, 244 aa, Glycine max
  misc_feature: Ceres CLONE ID NO.480529
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416 at SEQ ID NO.140
  misc_feature (30)..(30): Xaa is any aa, unknown, or other
  misc_feature (38)..(38): Xaa is any aa, unknown, or other
  misc_feature (77)..(77): Xaa is any aa, unknown, or other
  misc_feature (114)..(114): Xaa is any aa, unknown, or other
  misc_feature (124)..(124): Xaa is any aa, unknown, or other
MGRGRVQLKRIENKINRQVTFSKRRSGLLXKAHEISVXCDAEVALIVFSTKGKLFEYSSDPCMEKILERYERYSYAXRQLVASDQPLTENWTLEHAKLKARLEVLQKNQRNFMXQDLEGLSIKXLQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 153 - DNA, 1251 bp, Glycine max
  misc_feature: Ceres CLONE ID no.515898
  misc_feature: Encodes the peptide sequence at SEQ ID NO 154
gacgtacataaatataaagatgttgatagcatattataaatcatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttttcaaagagaaggtctggtttgctcaagaaagcacatgagatctctgtgctttgtgatgctgaagtggccctcatagtcttctccaccaaaggcaaactctttgagtactccagcgatccatgtatggaaagaattcttgaacggtatgagaggtattcatatgcagagaggcagcttgttgcaagtgatcaaccacaaactgaaaattggactctagaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctaaaaaaaaaaaaaaaaaaaaaaaaaaaa

SEQ ID NO: 154 - protein, 244 aa, Glycine max
  misc_feature: Ceres CLONE ID NO.515898
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416 at SEQ ID NO.140
MGRGRVQLKRIENKINRQVTFSKRRSGLLKKAHEISVLCDAEVALIVFSTKGKLFEYSSDPCMERILERYERYSYAERQLVASDQPQTENWTLEHAKLKARLEVLQKNQRNFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 155 - DNA, 1369 bp, Triticum aestivum
  misc_feature: Ceres CLONE ID no.751467
  misc_feature: Encodes the peptide sequence at SEQ ID NO 156
attccctgcgagctccacacagcatcacaccgcatttctcattcttcctccccacgtcgccgtagcagctagctagccggggagggaggggccgccgccgccgagtgagggagccgggggaggcgggttggaggcaggccggagatggggcgcgggccggtgcagctgcggcggatcgagaacaagataaaccggcaggtgaccttctccaagcgccgcagcgggttgctgaagaaggcgcacgagatctccgtgctctgcgacgccgaggtcgcgctcatcgtcttctccaccaagggcaagctatacgagtactccagccaggacagtagcatggatgtgattcttgaacgttaccaacgttactcatttgaagaaagagctgtactggatccaagtattggaaaccaggcaaactggggagatgaatatggaagtttgaagataaaactcgatgcactccagaagagtcaaaggcaactcttgggtgaacaattggacccactcaccacaaaagaactccaacagttggaacaacagcttgatagttctttgaagcacataaggtcaagaaagaatcaacttctctttgagtctatatctgagcttcaaaagaaggagaagtcattaaaagatcagaatggtgtcctgcagaagcacctcgtagagacagaaaaggagaaaaataacgttttgtcaaatattcatcaccaagagcagttgaatggagcaacaaatattcatcaccaggagcagctgaatggagcaacaacaagctcaccgtcacctacaccagcgacagcccaagattccatggcacctccaaatattgggccatatcaatctagagaatcaggaggggggaatccagaacctcagccgtctccagcacaagcaaacaacagcaatctaccagcgtggatgctccgcaccgtcagcaacagatgaaggctggcgacagcctcatatgactccacctgaaggcgagaatggcgcctgacatgcgcccactatggaagctagacgccggtgtgcagtccatctccggcaatggcttccggtgtagccactaataagaccacgcgtctttgctgctgggtgaatggggtcttcctgtcttaagcttttcctgcactataagatacttgtttccacgtttcggttccattttttctcctatcgatgagcacgatcttgtggttggagtttcgtgtgtaacctttaatggagttgcggtatgtttttacgtgttgtgacggtttttgtattccatccgttgtaaaaaaagcaaagggcgctgccttctctttacattgttattaaaaaaaaagagcagggcactgaacttttgacaaaaaaaaaaaaaaaa

SEQ ID NO: 156 - protein, 267 aa, Triticum aestivum
  misc_feature: Ceres CLONE ID NO.751467
  misc_feature (76)..(175): Pfam Name: K-box Pfam Description: K-box region
  misc_feature (9)..(59): Pfam Name: SRF-TF Pfam Description: SRF-type transcription factor
  misc_feature (1)..(267): Functional Homolog of  Ceres CLONE NO.246416 at SEQ ID NO.140
MGRGPVQLRRIENKINRQVTFSKRRSGLLKKAHEISVLCDAEVALIVFSTKGKLYEYSSQDSSMDVILERYQRYSFEERAVLDPSIGNQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHQEQLNGATNIHHQEQLNGATTSSPSPTPATAQDSMAPPNIGPYQSRESGGGNPEPQPSPAQANNSNLPAWMLRTVSNR

SEQ ID NO: 157 - DNA, 1299 bp, Panicum virgatum
  misc_feature: Ceres CLONE ID no.1757409
  misc_feature: Encodes the peptide sequence at SEQ ID NO 158
ctattcattccccgcgcaccactcgagtcgagagccacctgatccttcgttccccgtcttcctctcccccggcacgtcgctgtcgccattgccgcgccgctcgagagcggaagggggtaggtggggaagcggcggggatggggcgcgggccggtgcagctgcggcggatcgagaacaagatcaaccgccaggtgaccttctccaagcgccggaacgggctgctgaagaaggcgcacgagatctccgtgctctgcgacgccgaggtcgcgctcatcgtcttctccaccaaggggaggctctacgagtactccagcaatgacagcatggaaggcattcttgagcgttaccaacgatactcgtttgaagaaagagcagtacttgatccaaatattggagaccaggcaaactggggagatgaatatggctggttaaagaccaaacttgatgcacttcagaagagtcagaggcaactgttaggagaacaactggattcacttaccgtaaaagaactccagcaactggagcaacaactggacagctctctgaagcatataagatcaagaaagaatcagctcatgtttgattcaatttctgagcttcagaaaaaggagaaatcacttacagatcaaaatggtgtcctgcaaaagctcatggaggcagagaaagagaaaaacaatgcattaatgaatgcacacctccgggagcagcaaaatggagcatcaacaagcttgccatcaccaccgccatcaacagttccagattccatgccaactctaaatattaggccgcgtcaacctagagaaggaacagtaggggagtctgaacctgaatcgtctcctgctcaagtgaacagcggcaagctgcctccatggatgctacgcagtgtcagtaacagatgagctgttcctgatacggttctgcggctgaactcggatggcaaacacaccgtcaccaacacccttcggtgacccaggcatccataccggctcgatccagtagatgccagcatagtcactaataataagatcaggtatcaagtgctttacagggtgaataaagtctgaagctcctctgcaccatcatattgcgttttgttctcgcgtctgctgtctacctttttttttttctccgatcgacaagctcgtggttggagatgtatgctgtatcatgtttttcgtgtttacacttttacgaaaacagaaggctcttctcctggtaagggttgagtcccgatcaaagtgtcaaatgcgtaattcggtatcttagcagtattaacagcaaaaaaaaaaaaaaaaaaaa

SEQ ID NO: 158 - protein, 253 aa, Panicum virgatum
  misc_feature: Ceres CLONE ID NO.1757409
  misc_feature (1)..(253): Functional Homolog of  Ceres CLONE NO.246416 at SEQ ID NO.140
MGRGPVQLRRIENKINRQVTFSKRRNGLLKKAHEISVLCDAEVALIVFSTKGRLYEYSSNDSMEGILERYQRYSFEERAVLDPNIGDQANWGDEYGWLKTKLDALQKSQRQLLGEQLDSLTVKELQQLEQQLDSSLKHIRSRKNQLMFDSISELQKKEKSLTDQNGVLQKLMEAEKEKNNALMNAHLREQQNGASTSLPSPPPSTVPDSMPTLNIRPRQPREGTVGESEPESSPAQVNSGKLPPWMLRSVSNR

SEQ ID NO: 159 - protein, 265 aa, Hordeum vulgare subsp. vulgare
  misc_feature: Public GI ID NO.9367307
  misc_feature (76)..(175): Pfam Name: K-box Pfam Description: K-box region
  misc_feature (9)..(59): Pfam Name: SRF-TF Pfam Description: SRF-type transcription factor
  misc_feature (1)..(265): Functional Homolog of  Ceres CLONE NO.246416 at SEQ ID NO.140
MGRGPVQLRRIENKINRQVTFSKRRSGLLKKAHEISVLCDAEVALIVFSTKGKLYEYSSQDSSMDVILERYQRYSFEERAVLDPSTGDQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHREQLNEATNIHHQEQLSGATTSSPSPTPPTAQDSMAPPNIGPYQSRGGGDPEPQPSPAQANNSNLPPWMLRTIGNR

SEQ ID NO: 160 - protein, 249 aa, Oryza sativa; identical to SEQ ID NO: 142
  misc_feature: Public GI ID NO.50939129
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.246416 at SEQ ID NO.140

SEQ ID NO: 161 - protein, 244 aa, Triticum aestivum
  misc_feature: Public GI ID NO.58422998
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416 at SEQ ID NO.140
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQAPPRTGLPPWMVSHING

SEQ ID NO: 162 - protein, 255 aa, Arabidopsis thaliana
  misc_feature: Public GI ID NO.16162
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(255): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRNDLELTLEPVYNCNLGCFAA

SEQ ID NO: 163 - protein, 244 aa, Betula pendula
  misc_feature: Public GI ID NO.1483232
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416 at SEQ ID NO.140
MGRGRVQLKRIENKINRQVTFSKRRSGLLKKAHEISVLCDAEVALIVFSTKGKLFEYSTDSCMERILERYERYSYADRQLLANDLEQNGSWTLEHAKLKARIEVLQRNQKHFVGEDLDSLSLKELQNLEQQLDSALKHIRSRKNQLMYESISELQRKDKALQEQNNVLAKKVKEKEKELAQQAQWEQQSHTLDSVPSLLPQPLQSSLNIGGSQQARGNGRVDEGTPPHRANALLPPWMLRHLNQ

SEQ ID NO: 164 - protein, 254 aa, Sinapis alba
  misc_feature: Public GI ID NO.4416347
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(254): Functional Homolog of  Ceres CLONE NO.246416 at SEQ ID NO.140
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKEREKVLRAQQEQWDEQNHGHNMPPPPPLQQQIQHPYMLSHQPSPFLNMGGLYQEDQIAMRRNDLDLSLEPVYNCNLGCFAA

SEQ ID NO: 165 - protein, 249 aa, Oryza sativa
  misc_feature: Public GI ID NO.6175371
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.246416 at SEQ ID NO.140
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 166 - protein, 247 aa, Dendrobium grex Madame Thong-In
  misc_feature: Public GI ID NO.6467974
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(247): Functional Homolog of  Ceres CLONE NO.246416 at SEQ ID NO.140
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 167 - protein, 248 aa, Helianthus annuus
  misc_feature: Public GI ID NO.18996775
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416 at SEQ ID NO.140
MGRGKVQLRRIENKINRQVTFSKRRGGLLKKAHEISVLCDAEVALIVFSNKGKLFEFSTDSCMDSILERYERYSYTERQLVAADATPRSWTLEYNKLKSRAELLQRNHRHYMGEDIESLSLKEIQNLEQQLDTGLKNIRTRKNQLLHESISELQKKGKAIQEQNTTLTKKIKEKEKDKTIPQNTQWEMHNYVDHDTTFLMPPPPPALNMGGDYNHGGGGSSEGADGRTNELDLSLQPIYSCHMRCFPS

SEQ ID NO: 168 - protein, 251 aa, Arabidopsis thaliana
  misc_feature: Public GI ID NO.20799346
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMVMRRNDLELTLEPVYNCNL

SEQ ID NO: 169 - protein, 251 aa, Arabidopsis thaliana
  misc_feature: Public GI ID NO.20799348
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAVSPKELQNLEQQLDTALKHIRTRKNQLMYESINELQKKEKAIQEQNGMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 170 - protein, 251 aa, Arabidopsis thaliana
  misc_feature: Public GI ID NO.20799358
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSTEYNRLKAKIELLERNQRHYLGEDLQAMSPKEPQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 171 - protein, 251 aa, Arabidopsis thaliana
  misc_feature: Public GI ID NO.20799362
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQGQWDQQNQGHNMPPPLPPQQHQIQHPYMLSHQPSPFLNMGGLYQEDDPMAMRRNDLELTLEPVYNCNL

SEQ ID NO: 172 - protein, 251 aa, Arabidopsis thaliana
  misc_feature: Public GI ID NO.20799364
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKTKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 173 - protein, 251 aa, Arabidopsis thaliana
  misc_feature: Public GI ID NO.20799368
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 174 - protein, 251 aa, Arabidopsis lyrata
  misc_feature: Public GI ID NO.20799370
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLNAMSPKELQNLEQQLDTALKNIRTRKNQLMYESINELQRKEKAIQEQNSMLSKQIKEREKILRAQQEQWDQQNHGHNMPPPPPPQQHQIQHPYMLSHQPSPFLNMGGLYQEEDPMAMRRNELELTLEPVYNCNL

SEQ ID NO: 175 - protein, 256 aa, Arabidopsis thaliana; identical to SEQ ID NO: 148
  misc_feature: Public GI ID NO.21593537
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416 at SEQ ID NO.140

SEQ ID NO: 176 - protein, 242 aa, Daucus carota subsp. sativus
  misc_feature: Public GI ID NO.22091473
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.246416 at SEQ ID NO.140
MGRGKVQLKRIENKINRQVTFSKRRGGLLKKAHEISVLCDAEVALIVFSNKGKLFEYSTDSSMEEILERYERYSYAERQVIANDPESTGNWTLEYTKLKARIDLLQRDHRHYMGEDLDSLTLKEIQNLEQQLDTALKHIRSRKNQLIFESISDLQKKEKAIQEENGKLTKKIKEREKTMVQQAQWEKQNPSPNLSTFLMPQENPFLNIGGTFQGESSQGMTRNDLDLTLEPNHYPCNLRCFA

SEQ ID NO: 177 - protein, 240 aa, Populus tremuloides
  misc_feature: Public GI ID NO.28381537
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(240): Functional Homolog of  Ceres CLONE NO.246416 at SEQ ID NO.140
MGRGRVQLKRIENKINRQVTFSKRRAGLLKKAHEISVLCDAEVALIVFCHKGKLFEYSTNACMEKILERHERYSYAERQLVATDLDSQGNWTLEYNRLKEKVELLQRNHRHYLGEDLDSVSLKELQNLEKQIDTALELIRERKNHLMYQSISELQIKEKAIKEQNNMLVKQIKEKEKALAQPALWDQQDHGPNASSFLLPQPPLPCLNISYQEEDPIARRNELDLTLEPIYSCHLGCFGT

SEQ ID NO: 178 - protein, 279 aa, Lolium perenne
  misc_feature: Public GI ID NO.28630957
  misc_feature (76)..(175): Pfam Name: K-box Pfam Description: K-box region
  misc_feature (9)..(59): Pfam Name: SRF-TF Pfam Description: SRF-type transcription factor
  misc_feature (1)..(279): Functional Homolog of  Ceres CLONE NO.246416 at SEQ ID NO.140
MGRGPVQLRRIENKINRQVTFSKRRSGLLKKAHEISVLCDAEVALIVFSTKGKLYEYSSQDSNMDVILERYQRYSFEERAIVDQNIGGQANWGDEFGSLKIKLDALQKSQRQLLGEQLDPLTTKELQQLEQQLDSSLKHIRSRKNQLLFESISELQKKEKSLKDQNGVLQKHLVETEKEKSNVLSNIHHREQTNGAANIHRREQMNETTHIHNQEQLNGATTSSPSPTPVAVLDSVATLNIGSSQSREAAGEEPESQPSPAQANSGKLPPWMLRTISNR

SEQ ID NO: 179 - protein, 256 aa, Arabidopsis thaliana
  misc_feature: Public GI ID NO.28827280
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 180 - protein, 244 aa, Triticum monococcum
  misc_feature: Public GI ID NO.30090030
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416 at SEQ ID NO.140
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAAAGERAEDAAVQPQAPPRTGLPPWMVSHING

SEQ ID NO: 181 - protein, 250 aa, Elaeis guineensis
  misc_feature: Public GI ID NO.33309864
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.246416 at SEQ ID NO.140
MGRGRVQLRRIENKINRQVTFSKRRSGLLKKAHEISVLCDAEVALIIFSTKGKLYEYATDSCMERILERYERYTYAEKALISSGPELQGNWCHEFGKLKAKVEALQKSQRHLMGEQLEPLNLKELQQLEQQLESSLKHIRTRKCQLMFESISELQKKEKSLQEQNKMLEKELMEKQKVKALNQQAPWEQQGPPQTSSSSPTSFLIGDSLPTLNIGTYQCSGNEHGEEAAQPQVRIGNSLLPPWMLSHLNG

SEQ ID NO: 182 - protein, 243 aa, Citrus sinensis
  misc_feature: Public GI ID NO.37703726
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.246416 at SEQ ID NO.140
MGRGRVQLKRIENKINRQVTFSKRRAGFLKKAHEISVLCDAEVAVIIFSHKGKLFEYSTGSCMEKILERYERYAYAERQLIAPDPESQRNWPLECNNLKAKIDLLQKDQRHYLGEDLESLSLKDIQQLEQQLDTALKHIRSRKNQLMQESISELQKKEKSIEEQNNLLVKQIKEREKAAAQQAQWGNQIQNQVPNTLSFLLPQPPPCLRLGGAYQEQASEMRRNELNLTLEPVCSCSLGCFAG

SEQ ID NO: 183 - protein, 241 aa, Populus balsamifera subsp. trichocarpa; identical to SEQ ID NO: 144
  misc_feature: Public GI ID NO.47934197
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.246416 at SEQ ID NO.140

SEQ ID NO: 184 - protein, 248 aa, Populus balsamifera subsp. trichocarpa; identical to SEQ ID NO: 146
  misc_feature: Public GI ID NO.47934201
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416 at SEQ ID NO.140

SEQ ID NO: 185 - protein, 256 aa, Arabidopsis thaliana
  misc_feature: Public GI ID NO.51970008
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416 at SEQ ID NO.140
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHMRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 186 - protein, 244 aa, Triticum aestivum
  misc_feature: Public GI ID NO.58423008
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416 at SEQ ID NO.140
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAATTSIHPAASGERAEDAAVQPQAPPRTGLPLWMVSHING

SEQ ID NO: 187 - protein, 244 aa, Triticum aestivum
  misc_feature: Public GI ID NO.58423012
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416 at SEQ ID NO.140
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAAATSIHPAAAGERAGDAAVQPQAPPRTGLPLWMVSHING

SEQ ID NO: 188 - protein, 241 aa, Lotus japonicus
  misc_feature: Public GI ID NO.60100338
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.246416 at SEQ ID NO.140
MGRGRVQLKRIENKINRQVTFSKRRAGLLKKAHEISVLCDAEVALIVFSHKGKLFEYATDSCMEKILERYERYAYAERQLVANDSESQGNWTIEYTRLKAKIDLLQRNHRHYMGEDLGSMSLKELQSLEQQLDTALKHIRTRRNQLMYESISELQKKEKVIQEQNNMLAKKIKEKEKIAAQQQHAQWDHPNHGVNAPFLMQQPLPTLNMGGNYREDHAPDVGRNELDLTLEPLYSCHLGCF

SEQ ID NO: 189 - protein, 239 aa, Eriobotrya japonica
  misc_feature: Public GI ID NO.60116226
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(239): Functional Homolog of  Ceres CLONE NO.246416 at SEQ ID NO.140
MGGGRVQLKRIENKINRQVTFSKRRTGLLKKAHEISVLCDAQVAVVVFSNKGKLFEYATDSCMEQILERYERYSYAERQLVEPEFESQGNWTFEYCRLKAKVEVLQRNHRHYLGEDLDSLTLKEIQNLEQQLDTALKQIRLRKNQLMHESISELQRKRKAIQEENNLLAKKIKEKEKAAAQPQVQDWEQQNIGLDLLPQPLPCLNNGGTQQDEFLQVRRNQLDLTLEPLYSCHLGCFAA

SEQ ID NO: 190 - protein, 236 aa, Pisum sativum
  misc_feature: Public GI ID NO.62132631
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(236): Functional Homolog of  Ceres CLONE NO.246416 at SEQ ID NO.140
MGRGRVQLKRIENKINRQVTFSKRRCGLLKKAHEISVLCDAEVALIVFSNKGKLYEYSSDPCMERILERYERYSYAERQHVPNDQPQNENWIIEHAKLKARLEVIQKNQRNFMGEELDGLSMKELQNLEHQLDSALKQIRSRKNQVVYESISELQKKDKALQEKNNLLTKKIKEKEKALANFELHNDDMDLDSALVPQPLETPNIGCSPQDRGDNEGSQTQSNALLPPWMLRPIND

SEQ ID NO: 191 - protein, 250 aa, Salix discolor
  misc_feature: Public GI ID NO.67848418
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.246416 at SEQ ID NO.140
MGRGRVQLKRIENKINRQVTFSKRRTGLLKKAHEISVLCDAEVALIVFSHKGKLFEYSTDDCMEKILERYERYSYEERQLAATDFDSPGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPALWDDQQNQGPHASSFLLSQPAGLPLPCLNIGGCYQEETDPEVRRNELDHALEPTYSFHLGGYGA

SEQ ID NO: 192 - protein, 250 aa, Salix discolor
  misc_feature: Public GI ID NO.67848420
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.246416 at SEQ ID NO.140
MGRGRVQLKRIENKINRQVTFSKRRTGLLKKAHEISVLCDAEVALIVFSHKGKLFEYSTDDCMEKILERYERYSYEERQLATTDFDSQGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPAPIWDDQQNQGPHASSFLLSQPAGLPLPCLNIGGCYQEEAPEVRRNELDHALEPTYSFHLGGYGA

SEQ ID NO: 193 - protein, 240 aa, Medicago truncatula
  misc_feature: Public GI ID NO.72256323
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(240): Functional Homolog of  Ceres CLONE NO.246416 at SEQ ID NO.140
MGRGRVQLKRIENKINRQVTFSKRRAGLLKKAHEISVLCDAEVALIVFSHKGKLFEYATDSCMEKILERYERYSYAERQLVANDSESQGNWTIEYTRLKAKIDLLQRNYRHYMGEDLGSMSLKELQSLEQQLDTALKLIATRRNQVMYESISELQKKEKVIQEQNNMLAKKIKEKEKIAAQQQAQWEHPNHHGVNPNYLLQQQLPTLNMGGNYREEAPEMGRNELDLTLEPLYTCHLGCF

SEQ ID NO: 194 - protein, 248 aa, Misopates orontium
  misc_feature: Public GI ID NO.82734203
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416 at SEQ ID NO.140
MGRGKVQLKRIENKINRQVTFSKRRGGLLKKAHEISVLCDAEVALIVFSNKGKLFEYSTDSCMDRILEKYERYSFAERQLVSNEPQSPANWTLEYSKLKARIELLQRNHRHYMGEDLDSMSLKELQSLEQQLDTALKNIRSRKNQLLYDSISDLQRKEKAIQEQNTMLAKKIKEKEKELAQQPQWEHHRHHTNASIMPPPPQYSMAPQFPCINVGNTYEGEGANEDRRNELDLTLDSLYSCHLGCFAA

SEQ ID NO: 195 - DNA, 586 bp, Arabidopsis thaliana
  misc_feature: Ceres CLONE ID no.1010174
  misc_feature: LOCUS At4g09960
  misc_feature: Encodes the peptide sequence at SEQ ID NO 196
atcaagttcccatctttgtacacatctcttcattcaaaaactctacatttatatctctatatatgcagattccaagcttgtaataattcttgtcatcatgggtttttttcttgccttgtctctccagaaaacttaattttcacaattatgaattattttccttatttttgttactttcttctgtttgatgctctttccccatgaaagaaagaaagagaaagaaagatcacaagggttttatttggtcaccagattaagaattaggatgggaagaggaaagatagcmaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactc

SEQ ID NO: 196 - protein, 256 aa, Arabidopsis thaliana
  misc_feature: Ceres CLONE ID NO.1010174
  misc_feature: LOCUS At4g09960
  misc_feature (100)..(199): Pfam Name: K-box Pfam Description: K-box region
  misc_feature (35)..(85): Pfam Name: SRF-TF Pfam Description: SRF-type transcription factor
MLFPHERKKEKERSQGFYLVTRLRIRMGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 197 - DNA, 675 bp, Populus balsamifera subsp. trichocarpa
  misc_feature: Ceres ANNOT ID no.1540248
  misc_feature: Encodes the peptide sequence at SEQ ID NO 198
atgggaagaggaaagattgagatcaagaggatcgagaacactacgaatcgtcaggttactttctgcaagagaagaaatgggctgttgaagaaagcctatgaattatctgtcctttgtgatgctgaagtttccctcatcgtcttctctagccgtggccgtctctatgagtacgccaacaacaatataagatcaactatagataggtacaagaaggtcagttcagatagttcaaatactgcctctatcacagaaatcaatgcccagtattatcaacaagaatcagcaaagatgcgtcaacaaattcagttgctacagaattctaacaggcacttaatgggagaagccgtgagtaatctgtcggtgaaggagctaaagcagctggagaataggctcgaaagaggcatgactagaatcaggtcaaagaagcatgaattgctgctagctgaaattgagtatatgcagaaaagggagattgagctggaaaatgaaagtgcctgtcttcgaaccaagatagcggaagttgagaggcttcaacaagccaacatggtcaccggagaagagctgaatgcaatccaggcattagcagcctctcgcaatttctttgctcctcattttcttgagggtggaactgcatacccgcacacttataacaagaagattctccatcttgggtaa

SEQ ID NO: 198 - protein, 224 aa, Populus balsamifera subsp. trichocarpa
  misc_feature: Ceres ANNOT ID NO.1540248
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(224): Functional Homolog of  Ceres CLONE NO.1010174 at SEQ ID NO.196 with e-value of 6.30E-81 and BLAST sequence identity of 75.7
MGRGKIEIKRIENTTNRQVTFCKRRNGLLKKAYELSVLCDAEVSLIVFSSRGRLYEYANNNIRSTIDRYKKVSSDSSNTASITEINAQYYQQESAKMRQQIQLLQNSNRHLMGEAVSNLSVKELKQLENRLERGMTRIRSKKHELLLAEIEYMQKREIELENESACLRTKIAEVERLQQANMVTGEELNAIQALAASRNFFAPHFLEGGTAYPHTYNKKILHLG

SEQ ID NO: 199 - DNA, 1057 bp, Arabidopsis thaliana
  misc_feature: Ceres CLONE ID no.32791
  misc_feature: Encodes the peptide sequence at SEQ ID NO 200
gtttttgggattctcaaaaaactcaaaataaactttcctcattttttttttctttcttttgttttgttttctttataaaggagaaagaaagagaaagagagtttccgaaagctgaattgagttgggtgaagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgtatcatagtatctattctatggtatctcc

SEQ ID NO: 200 - protein, 230 aa, Arabidopsis thaliana
  misc_feature: Ceres CLONE ID NO.32791
  misc_feature (74)..(173): Pfam Name: K-box Pfam Description: K-box region
  misc_feature (9)..(59): Pfam Name: SRF-TF Pfam Description: SRF-type transcription factor
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 201 - DNA, 1218 bp, Zea mays
  misc_feature: Ceres CLONE ID no.228787
  misc_feature: Encodes the peptide sequence at SEQ ID NO 202
acatcctctttcagttccctctctggatctcttcctgaagagaggcactgccacaccaccacgccacccatgctcaacatgatgaccgatctgagctgcgggccgtcgtccaaggcgaaaggagggcagccggcagcgacgacgggctccggcggcgacaggcaggggaggggcaagatcgagatcaagcgcatcgagaacacgacgaaccggcaggtcaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgacacctccaactctggcacagttgcagaagtcaatgctcagcactaccagcaggagtcctccaagctgcgccaggcgatcgatagcttgcaaaacgcaaacaggaccatagtgggagattcaatccacaccatgggcctcagggagcttaagcagatggagggcaagctggagaaggccataaacaagattagagctagaaagaatgagctcttgtatgctgaagttgaatatatgcaaaaaagggagatggatctgcagactgacaacatgtacctgaggagcaagatcgccgagaataatgaaacggggcagccagcgatgaacatgattggagtgccgtcgacgagcgagtacgatcacatggccccttttgttgactcgagaaactttcttcaggtgaacatgcagcagcagcctcagcactactcccatcagctgcaaccaacgaccctccaactcggatgatgaaattaagaatcttcggccaacaatccatgcatccacgcaaggacgcagtaaatcatgtgtccaactcagataaaaatctactctagcgtttgtataattattaataatcgtgactagtaaactgttatatatatagccatatgtgtgtggcgcctacatatatgtcatgtggctgtacggcgagttttttttcacaagcgtttgcagcagcatttggtgttgctcatccatcaattaatcgcaagaaattaaacctgtcaccaccgtgtgtgcatttgtacgtgttaatgcagttgctgtatccgttaattgtaccctccatcagataaacgcgggtgcgcgtatgcatacttatttatgtgt

SEQ ID NO: 202 - protein, 260 aa, Zea mays
  misc_feature: Ceres CLONE ID NO.228787
  misc_feature (105)..(204): Pfam Name: K-box Pfam Description: K-box region
  misc_feature (40)..(90): Pfam Name: SRF-TF Pfam Description: SRF-type transcription factor
  misc_feature (1)..(260): Functional Homolog of  Ceres CLONE NO.1010174 at SEQ ID NO.196 with e-value of 2.39E-63 and BLAST sequence identity of 63.8
MLNMMTDLSCGPSSKAKGGQPAATTGSGGDRQGRGKIEIKRIENTTNRQVTFCKRRNGLLKKAYELSVLCDAEVALVVFSSRGRLYEYANNSVKSTIERYKKANSDTSNSGTVAEVNAQHYQQESSKLRQAIDSLQNANRTIVGDSIHTMGLRELKQMEGKLEKAINKIRARKNELLYAEVEYMQKREMDLQTDNMYLRSKIAENNETGQPAMNMIGVPSTSEYDHMAPFVDSRNFLQVNMQQQPQHYSHQLQPTTLQLG

SEQ ID NO: 203 - DNA, 1353 bp, Glycine max
  misc_feature: Ceres CLONE ID no.1044034
  misc_feature: Encodes the peptide sequence at SEQ ID NO 204
cagttcacaccctagagggagtggatggattttgttgtttttcatataagggcaaagaaagatagaggagctagctagctagcgagcttcaaaactcaaaagcactgacacatacaaacaaaaagatctggctttcataaaattgagataaaagtgcaccgtctccgaatcatgtttataatattatcttcattagatcttgatctcatttttcatctgaaactaaaagaatatatatgtgcctttaccctatttagctatatgcacacacaacttgtcacatatcatattttgttcatcaagtttataattccttatctttgaacttacttacatccaagtaaggtctaagctagctggagttgattagatctagctagctagttttcgatctgcttaatttgttttccatgatctcttatatatagtaattttatttccctttaattaattaagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcaaatacagatgctgcaaaattctaacaggcacctgatgggtgatgccttaagcacactgactgtgaaggaacttaagcagttggagaatagacttgaaagaggaatcactagaatcagatctaagaaacatgagatgctactggctgaaattgaatacttccagaaaagggagattgaactggaaaatgaaaatctttgcctccgaactaagataactgacgtggagaggattcagcaagtaaacatggtttctgggccagaactgaatgccattcaggcattagcttcccgtaacttcttcaatccaaatatgttggaaggtggaactgtttaccctcactcagataagaagattcttcatcttgggtgatcaataatatatgatcttggctagcctatggcatgtctatccaattagccggtggctaaatgcattattattactactcttttggttgctcattaactagaccatgtgatctatatactacttatggattatggatacttatgtatgatgattgtatgatatcataacaatcagttagaaataataattaaaaaatagagttgtgtttgaag

SEQ ID NO: 204 - protein, 222 aa, Glycine max
  misc_feature: Ceres CLONE ID NO.1044034
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(222): Functional Homolog of  Ceres CLONE NO.1010174 at SEQ ID NO.196 with e-value of 8.60E-84 and BLAST sequence identity of 77.9
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 205 - DNA, 1138 bp, Glycine max
  misc_feature: Ceres CLONE ID no.1044749
  misc_feature (686)..(686): n is a, c, t, g, unknown, or other
  misc_feature (687)..(687): n is a, c, t, g, unknown, or other
  misc_feature: Encodes the peptide sequence at SEQ ID NO 206
aaaacattcacgtcgagtacttggtttgggaaaaaaagccattcaagcttagctggtcctctctcctgtctctctctctctgtctgtctctctctgtctgtctctctctcaagcacatacacaaacaaagtaagggctataaataggagggatggaagtggaagaaagtctatagcgaagtttcatttctttggattagaaatttttcccaaagctgatcgagaagccagccaggccagaaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcggatcattcaagtgcgagcactaccacagaaatcaatgctcagtattatcaacaagaatctgctaagctgcgacagcaaatacagatgctgcaaaattctaacaggcacctgatgggtgatgccttgagcmcactgactgtgaaggaacttaagcagttgggagaatagacttgaaagaggaatcactagaatcagatttaagaaacatgagnngctattggctgaaattgaatactttcagaaaagggagattgagctggaaaatgaaaatctttgcctccggactaagataacygacgttgagaggattcagcaagtaaacatggtttctggaccagaactgaatgtcattcaggcattagcttcccgtaacttcttcaatccaaacatgttggacggtggaactgtttaccctcagacagataagaagattcttcatcttgggtgatcaataatatgatcttcgctatagcctataactatctatccaattagccggaggctaaatgcattattattactactcttttgattgctcattaactagaccaaatgatctatatacattacatatgaattatggattatggatacttatgtttaatgattgtatgatatcataacaatatgttagaaataataattaaaaagtagagttgtgttt

SEQ ID NO: 206 - protein, 222 aa, Glycine max
  misc_feature: Ceres CLONE ID NO.1044749
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(222): Functional Homolog of  Ceres CLONE NO.1010174 at SEQ ID NO.196 with e-value of 3.69E-83 and BLAST sequence identity of 77.0
MGRGKIEIKRIENTTNRQVTFCKRRNGLLKKAYELSVLCDAEVSLIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNVIQALASRNFFNPNMLDGGTVYPQTDKKILHLG

SEQ ID NO: 207 - protein, 252 aa, Brassica napus
  misc_feature: Public GI ID NO.399096
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(252): Functional Homolog of  Ceres CLONE NO.1010174 at SEQ ID NO.196 with e-value of 4.90E-65 and BLAST sequence identity of 67.4
MAYQMELGGESSPQRKAGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 208 - protein, 236 aa, Oryza sativa
  misc_feature: Public GI ID NO.886405
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(236): Functional Homolog of  Ceres CLONE NO.1010174 at SEQ ID NO.196
MGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 209 - protein, 254 aa, Triticum aestivum
  misc_feature: Public GI ID NO.24636577
  misc_feature (30)..(80): Pfam Name: SRF-TF Pfam Description: SRF-type transcription factor
  misc_feature (95)..(194): Pfam Name: K-box Pfam Description: K-box region
  misc_feature (1)..(254): Functional Homolog of  Ceres CLONE NO.1010174 at SEQ ID NO.196 with e-value of 5.59E-64 and BLAST sequence identity of 66.6
MVKESASPGSGSGSPGGAAEKMGRGRIEIKRIENTTNRQVTFCKRRNGLLKKAYELSVLCDAEVALIVFSGRGRLYEYSNNSVKATIERYKKATSDTSSAGTVAEINAQHYQQESAKLKQQITTLQNSNRTLIGDTMATMSHRDLKQLEGRLDKGLGKIRARKNELLCAEIEYMQRREMELQNNNFFLREKVAETERGQQQTLNMMGAASTSNEYEQNMIHCDPRTFLQFNFMQQQPQYYSQQEDRKSLNSVGR

SEQ ID NO: 210 - protein, 242 aa, Panax ginseng
  misc_feature: Public GI ID NO.861081
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(242): Functional Homolog of  Ceres CLONE NO.1010174 at SEQ ID NO.196
MSFYDDQSGNLSPQRKLGRGKIEIKRIENTTNRQVTFCKRRNGLLKKAYELSVLCDAEVALIVFSTRGRLYEYANNSVKGTIERYKKACTDSPNTSSVSEANAQFYQQEASKLRQEISSIQKNNRNMMGESLGSLTVRDLKGLETKLEKGISRIRSKKNELLFAEIEYMQKKEIDLHNNNQYLRAKIAENERAQQHMNLMPGSSDYELAPPQSFDGRNYIQLNGLQPNNHYSRQDQTALQLV

SEQ ID NO: 211 - protein, 229 aa, Cucumis sativus
  misc_feature: Public GI ID NO.2997615
  misc_feature (74)..(177): Pfam Name: K-box Pfam Description: K-box region
  misc_feature (9)..(59): Pfam Name: SRF-TF Pfam Description: SRF-type transcription factor
  misc_feature (1)..(229): Functional Homolog of  Ceres CLONE NO.1010174 at SEQ ID NO.196 with e-value of 2.10E-82 and BLAST sequence identity of 77.6
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 212 - protein, 248 aa, Nicotiana tabacum
  misc_feature: Public GI ID NO.3913007
  misc_feature (1)..(248): Functional Homolog of  Ceres CLONE NO.1010174 at SEQ ID NO.196 with e-value of 3.69E-67 and BLAST sequence identity of 71.1
MDFQSDLTREISPQRKLGRGKIEIKRIENTTNRQVTFCKRRNGLLKKAYELSVLCDAEVALIVFSSRGRLYEYANNSVKATIERYKKACSDSSNTGSISEANAQYYQQEASKLRAQIGNLQNQNRNMLGESLAALSLRDLKNLEQKIEKGISKIRSKKNELLFAEIEYMQKREIDLHNNNQYLRAKIAETERAQQQQQQQQMNLMPGSSSYELVPPPHQFDTRNYLQVNGLQTNNHYTRQDQPSLQLV

SEQ ID NO: 213 - protein, 225 aa, Cucumis sativus
  misc_feature: Public GI ID NO.4103342
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(225): Functional Homolog of  Ceres CLONE NO.1010174 at SEQ ID NO.196 with e-value of 5.29E-84 and BLAST sequence identity of 77.6
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 214 - protein, 242 aa, Corylus avellana
  misc_feature: Public GI ID NO.4103757
  misc_feature (24)..(74): Pfam Name: SRF-TF Pfam Description: SRF-type transcription factor
  misc_feature (90)..(189): Pfam Name: K-box Pfam Description: K-box region
  misc_feature (1)..(242): Functional Homolog of  Ceres CLONE NO.1010174 at SEQ ID NO.196 with e-value of 5.49E-66 and BLAST sequence identity of 66.0
MEFQNQSMSVSPQRKLGRGKIEIKRIENTTNRQVTFCKRRNGLLKKAYELSVLCDAEIALIVFSSRGRLYEYANNSSVKTTIERYKKACADSSNSGSVSEANTQFYQQEAAKLRGQIRSVQDSNRHMLGEALSELNFKELKNLEKNLEKGINRIRSKKNELLLAEIEYMHKREVDLHNNNQFLRAKIAENERNQQNLNVMPGGGNYELMQSQSFDSRNYFQVDALQPNHHYPRQDQMALQLV

SEQ ID NO: 215 - protein, 264 aa, Gerbera hybrid cv. 'Terra Regina'
  misc_feature: Public GI ID NO.4218160
  misc_feature (103)..(209): Pfam Name: K-box Pfam Description: K-box region
  misc_feature (41)..(91): Pfam Name: SRF-TF Pfam Description: SRF-type transcription factor
  misc_feature (1)..(264): Functional Homolog of  Ceres CLONE NO.1010174 at SEQ ID NO.196 with e-value of 2.40E-65 and BLAST sequence identity of 66.8
MENSDVLELDFSCVDRSMSFPDDTGDMSPQRKMGKGKIEIKRIENTTNRQVTFCKRRNGLLKKAYELSVLCDAEVALIVFSSRGRLYEYANNSVKGTIDKYKKACLDPPTSGTVAEANTQYYQQEAAKLRQQIANLQNQNRQFYRNIMGESLGDMPVKDLKNLEGKLEKAISRIRAKKNELLFAEIEYMQKRELELHNSNQFLRAKIVENERAQQHHMSLMPGSSDYELVTPHQPFDGRNYLQTNDLQPNNDYSCQDQTPLQLV

SEQ ID NO: 216 - protein, 242 aa, Betula pendula
  misc_feature: Public GI ID NO.8745072
  misc_feature (24)..(74): Pfam Name: SRF-TF Pfam Description: SRF-type transcription factor
  misc_feature (89)..(189): Pfam Name: K-box Pfam Description: K-box region
  misc_feature (1)..(242): Functional Homolog of  Ceres CLONE NO.1010174 at SEQ ID NO.196 with e-value of 9.99E-65 and BLAST sequence identity of 66.0
MEFQNQSMSVSPQRKLGRGKIEIKRIENTTNRQVTFCKRRNGLLKKAYELSVLCDAEIALIVFSSRGRLYEYANNSSVKTTIERYKKACAESSNSGSVSEANTQFYQQEAAKLRGQIRSVQNSNRHLLGEALSELNFKELKNLEIKLEKGINKIRSKKNELLFAEIEYMQKREAELHNNNQILRAKIAENERNQQNLNVMPGGGNYELMQSQSYDSRTYFQVDALQPNHHYPRQDQIPLQLV

SEQ ID NO: 217 - protein, 223 aa, Vitis vinifera
  misc_feature: Public GI ID NO.20385590
  misc_feature (69)..(173): Pfam Name: K-box Pfam Description: K-box region
  misc_feature (9)..(59): Pfam Name: SRF-TF Pfam Description: SRF-type transcription factor
  misc_feature (1)..(223): Functional Homolog of  Ceres CLONE NO.1010174 at SEQ ID NO.196 with e-value of 9.90E-83 and BLAST sequence identity of 77.5
MGRGKIEIKRIENTTNRQVTFCKRRNGLLKKAYELSVLCDAEVALIVFSSRGRVYEYSNNNIKSTIDRYKKASSDSTNGGFTMEINAQYYQQESAKLRQQIQMLQNSNRHLMGDSLASLTVKELKQLENRLERGITRIRSKKHELLLAEIEYLQKREIELENESVYLRTKIAEVERLQQANMVSTHEFNAIQALVSRNFFQPNMIEGGSTGYPLHDKKVLHLG

SEQ ID NO: 218 - protein, 234 aa, Hyacinthus orientalis
  misc_feature: Public GI ID NO.21955182
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(234): Functional Homolog of  Ceres CLONE NO.1010174 at SEQ ID NO.196 with e-value of 2.50E-70 and BLAST sequence identity of 67.5
MGRGKIEIKRIENTTNRQVTFCKRRNGLLKKAYELSVLCDAEVALIVFSTRGRLYEYSNNSIKSTIERDKKACADSSSSSAVIEVNTQRYYQQEASKLRQQIQILQNANRHLMGESLDPLNVKELKQLETRLERGITRVRSKKHELLFAELEYMQKREVELQTDNMYLRAKIGENERAHQASVVQAGTEFDALPTFDSRNYYQVHMLQAASHYSHHQDQTALHLGYETKADPSA

SEQ ID NO: 219 - protein, 223 aa, Gossypium hirsutum
  misc_feature: Public GI ID NO.23194453
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(223): Functional Homolog of  Ceres CLONE NO.1010174 at SEQ ID NO.196 with e-value of 3.20E-86 and BLAST sequence identity of 80.1
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHPSDKKILHLG

SEQ ID NO: 220 - protein, 247 aa, Helianthus annuus
  misc_feature: Public GI ID NO.27657747
  misc_feature (24)..(74): Pfam Name: SRF-TF Pfam Description: SRF-type transcription factor
  misc_feature (86)..(192): Pfam Name: K-box Pfam Description: K-box region
  misc_feature (1)..(247): Functional Homolog of  Ceres CLONE NO.1010174 at SEQ ID NO.196 with e-value of 3.09E-63 and BLAST sequence identity of 68.7
MSFPNESGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLEGKLEKGISRIRSKKNELLFAEIEYMPKRENELHNNNQFLRAKIAENERSQQQHMSLMPGSSDYDLVPPHQPFDGRNYLQVNDLQPNNSYSCQDQTPLQLV

SEQ ID NO: 221 - protein, 227 aa, Momordica charantia
  misc_feature: Public GI ID NO.27763670
  misc_feature (74)..(177): Pfam Name: K-box Pfam Description: K-box region
  misc_feature (9)..(59): Pfam Name: SRF-TF Pfam Description: SRF-type transcription factor
  misc_feature (1)..(227): Functional Homolog of  Ceres CLONE NO.1010174 at SEQ ID NO.196 with e-value of 3.39E-82 and BLAST sequence identity of 76.6
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 222 - protein, 235 aa, Agapanthus praecox
  misc_feature: Public GI ID NO.29467048
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(235): Functional Homolog of  Ceres CLONE NO.1010174 at SEQ ID NO.196 with e-value of 4.79E-74 and BLAST sequence identity of 69.6
MGRGKIEIKRIENTTNRQVTFCKRRNGLLKKAYELSVLCDAEVALIVFSTRGRLYEYSNNSIKSTIERYKKACADSSNSTAVVEVNTQQYYQQEAAKLRHQIQSLQNSNRHLMGDSLSSLSIKELKQLENRLERGITRIRSKKHELLFAEIEYMQKREAELQNDNMYLRAKITDNERAHQVSVVQSGTEYDTLPTFDSRNYYTHVTMLEAAPHFSHHQDHTALHLGYETKADPTE

SEQ ID NO: 223 - protein, 225 aa, Meliosma dilleniifolia
  misc_feature: Public GI ID NO.42794560
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(225): Functional Homolog of  Ceres CLONE NO.1010174 at SEQ ID NO.196 with e-value of 4.49E-71 and BLAST sequence identity of 69.9
MGRGKIEIKRIENTTNRQVTFCKRRNGLLKKAYELSVLCDAEVALIVFSTRGRLYEYANNSVKATIDRYKKACADTSNTGSVSEANAQFYQQESSKLRQQIVILQNSNRHLMGEALSAMTVKELKQLEGRLEKGISRIRSKKNEMLFAEIEYMQKREIDMQNDNMYLRAKIAENERAQQHMSMMPTSEYEAMPPQQFDSRNFLQVNLLEPNHHYSRQEQTALQLG

SEQ ID NO: 224 - protein, 226 aa, Saruma henryi
  misc_feature: Public GI ID NO.42794566
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(226): Functional Homolog of  Ceres CLONE NO.1010174 at SEQ ID NO.196 with e-value of 6.80E-68 and BLAST sequence identity of 68.9
MGRGKIEIKRIENTTNRQVTFCKRRNGLLKKAYELSVLCEAEVALIVFSSRGRLYEYANNSVRTTIDRYKKASDSSNPASVSETNSQYYQQEATKLRQQIGILQNANRHLMGESLSSMSVKELKQLETRLEKGISRIRSKKNELLFAEIEYMQKREVELQNDNIFLRGKIVENERAQQNMNMLPGGGGYEVMSQHPPYDSRNYLPVNLLEHNQHFSHQEPTALQLG

SEQ ID NO: 225 - protein, 226 aa, Crocus sativus
  misc_feature: Public GI ID NO.45549323
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(226): Functional Homolog of  Ceres CLONE NO.1010174 at SEQ ID NO.196 with e-value of 9.60E-69 and BLAST sequence identity of 66.1
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLG

SEQ ID NO: 226 - protein, 228 aa, Crocus sativus
  misc_feature: Public GI ID NO.45549325
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(228): Functional Homolog of  Ceres CLONE NO.1010174 at SEQ ID NO.196 with e-value of 9.60E-69 and BLAST sequence identity of 66.1
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLGFV

SEQ ID NO: 227 - protein, 229 aa, Akebia trifoliata
  misc_feature: Public GI ID NO.48727598
  misc_feature (16)..(66): Pfam Name: SRF-TF Pfam Description: SRF-type transcription factor
  misc_feature (80)..(180): Pfam Name: K-box Pfam Description: K-box region
  misc_feature (1)..(229): Functional Homolog of  Ceres CLONE NO.1010174 at SEQ ID NO.196 with e-value of 1.20E-72 and BLAST sequence identity of 68.0
MQKREGDMGRGKIEIKRIENTTNRQVTFCKRRNGLLKKAYELSVLCDAEVALIVFSSRGRLYEFSNSSIKSTIERYKKASADSSNTTSIIEANAHYYQHEATKLRQQIQNLQIANRQLMGDSLSSLTVKELKQLENRLERGLTRIRSKKQEIMFAEIEYMQKREVELQKENMYLRAKIAENENAQQTSMVPAQEFDAIQTFDSRNYFQMNMLEGGAAYSHADQTALHLG

SEQ ID NO: 228 - protein, 243 aa, Prunus persica
  misc_feature: Public GI ID NO.52219460
  misc_feature (25)..(75): Pfam Name: SRF-TF Pfam Description: SRF-type transcription factor
  misc_feature (89)..(189): Pfam Name: K-box Pfam Description: K-box region
  misc_feature (1)..(243): Functional Homolog of  Ceres CLONE NO.1010174 at SEQ ID NO.196 with e-value of 3.69E-67 and BLAST sequence identity of 67.9
MAYENKSMSLDSPQRKLGRGKIEIKRIENTTNRQVTFCKRRNGLLKKAYELSVLCDAEVALIVFSNRGRLYEYANNSVKETIERYKKACAESTNTGSVSEASTQYYQQEAAKLRAQTGNLQNSSRHMMGESLSSMNMKDLKNLESKLEKGINRIRSKKNELLFAEIEYMQKREIDLHNNNQLLRAKIAENERSQQNINVMAGGGSYEIMQSQPYDSRNYFQVNALQPNHQYNSRQDPMALQLV

SEQ ID NO: 229 - protein, 234 aa, Asparagus virgatus
  misc_feature: Public GI ID NO.57157565
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(234): Functional Homolog of  Ceres CLONE NO.1010174 at SEQ ID NO.196 with e-value of 1.50E-72 and BLAST sequence identity of 70.2
MGRGKIEIKRIENTTNRQVTFCKRRNGLLKKAYELSVLCDAEVALIVFSSRGRLYEYANNSIKSTIERYKKACADSSNSNAVIEVNSQQYYQQEAAKLRHQIQILQNANRHLMGDSLSSLTVKELKQLENRLERGITRIRSKKHELLFAEIEYMQKREAELQNDNMYLRAKISENERAHQVSVVQPGPEFDTLPTFDSRNYYNVHMLEAAPHYSHHQDQTALHLGYENKADPAA

SEQ ID NO: 230 - protein, 224 aa, Elaeis guineensis
  misc_feature: Public GI ID NO.58201609
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(224): Functional Homolog of  Ceres CLONE NO.1010174 at SEQ ID NO.196 with e-value of 5.90E-69 and BLAST sequence identity of 66.1
MGRGKIEIKRIENTTNRQVTFCKRRNGLLKKAYELSVLCDAEVALIVFSSRGRLYEYANNSVKATIERYKRACTDTSNSGSVSEADSQYYQQESTKLRQQIISLQNSNRNLMGESLGSMSPRDLKQLEGRLEKGINKIRTKKNELLFAEIEYMQKREVELQNANMYLRNKIAENERAQQQMNMLPQTTEYEVMAPYDSRNFLQVNLMQSNQHYSHQQQTTLPLG

SEQ ID NO: 231 - protein, 223 aa, Lotus japonicus
  misc_feature: Public GI ID NO.60100358
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(223): Functional Homolog of  Ceres CLONE NO.1010174 at SEQ ID NO.196 with e-value of 1.19E-84 and BLAST sequence identity of 79.2
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGQELNAIQALASRNFFNPPMIEDGTSYPQQPDKKILHLG

SEQ ID NO: 232 - protein, 221 aa, Prunus dulcis
  misc_feature: Public GI ID NO.63094569
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(221): Functional Homolog of  Ceres CLONE NO.1010174 at SEQ ID NO.196 with e-value of 2.29E-83 and BLAST sequence identity of 76.9
MGRGKIEIKRIENTTNRQVTFCKRRNGLLKKAYELSILCDAEVALIVFSSRGRLYEYSNNNIRNTIEGYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 233 - protein, 235 aa, Musa acuminata
  misc_feature: Public GI ID NO.66735452
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(235): Functional Homolog of  Ceres CLONE NO.1010174 at SEQ ID NO.196 with e-value of 1.50E-72 and BLAST sequence identity of 71.4
MGRGKIEIKRIENTTNRQVTFCKRRNGLLKKAYELSVLCDAEVALIVFSSRGRLYEYANNNIKSTIERYKKACADSSSSDAIVDVNSQHYYQQESAKLRHQIQVLQNANRHLMGDALSSLNVKELKQLENRLERSITRIRSKKHELLFAEIEYMQKREVELQSDNMYPRAKIAENERVQQLSIVEAGAEYDAIPGAFDSRNYYHANILEAAAHYSHHQDQTALQLGYETKADSAA

SEQ ID NO: 234 - protein, 252 aa, Brassica juncea
  misc_feature: Public GI ID NO.67043458
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(252): Functional Homolog of  Ceres CLONE NO.1010174 at SEQ ID NO.196 with e-value of 4.39E-64 and BLAST sequence identity of 66.9
MAYQTELGGESSSQRKAGRGKIEIKRIENTTNRQVTFCKRRNGLLKKAYELSVLCYAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 235 - protein, 230 aa, Beta vulgaris
  misc_feature: Public GI ID NO.68132368
  misc_feature (74)..(177): Pfam Name: K-box Pfam Description: K-box region
  misc_feature (9)..(59): Pfam Name: SRF-TF Pfam Description: SRF-type transcription factor
  misc_feature (1)..(230): Functional Homolog of  Ceres CLONE NO.1010174 at SEQ ID NO.196 with e-value of 1.30E-64 and BLAST sequence identity of 67.3
  misc_feature (199)..(199): Xaa is any aa, unknown, or other
  misc_feature (212)..(212): Xaa is any aa, unknown, or other
MGRGKIEIKRIENTTNRQVTFCKRRNGLLKKAYELSVLCDAEVALIVFSSRGRLYEYANHSVKGTIDRYKKACSNQSGAGSVAEANAQYYQQEAAKLRNQIRTATENNRLLSRHMMGEGLSSLSMKELKNLETKLERGISRIRSKKNELLFAEIEFMQKREIELHNNNQFLRARISENERAQQSMSLMPGGSDYDLVPXQSFDSRNYFQVNXLQPSSQYARQDQTPLQLV

SEQ ID NO: 236 - protein, 242 aa, Castanea mollissima
  misc_feature: Public GI ID NO.73537275
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(242): Functional Homolog of  Ceres CLONE NO.1010174 at SEQ ID NO.196 with e-value of 1.89E-65 and BLAST sequence identity of 67.9
MVYPNQSMSLSPQRKIGRGKMEMKRIENTTNRQVTFCKRRNGLLKKAYELSVLCDAEVALIVFSTRGRLYEYANNSVKSTIERYKKACADSSNTGSVAEANTQFYQQESAKLRAQIGNLQNSKQANDGESLSNLTVKELKSLEIKLERGISRIRSKKNELLFAEIEYMQKREVELHNNNQLLRAKIAENERNQQNLNVMPAGGGSYELMQTQQYDSRNFFQVNALQPNHQYPREDQMSLQLV

SEQ ID NO: 237 - DNA, 1202 bp, Arabidopsis thaliana
  misc_feature: Ceres CLONE ID no.22339
  misc_feature: Ceres LOCUS ID At3g58780
  misc_feature: Encodes the peptide sequence at SEQ ID NO 238
gttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttcccctcataacgattaagagagagacgagagagttcattttatatttataacgcgactgtgtattcatagtttaggttctaataatgataataacaaaactgttgtttc

SEQ ID NO: 238 - protein, 248 aa, Arabidopsis thaliana
  misc_feature: Ceres CLONE ID NO.22339
  misc_feature: Ceres LOCUS ID At3g58780
  misc_feature (24)..(74): Pfam Name: SRF-TF Pfam Description: SRF-type transcription factor
  misc_feature (89)..(188): Pfam Name: K-box Pfam Description: K-box region
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 239 - DNA, 717 bp, Populus balsamifera subsp. trichocarpa
  misc_feature: Ceres ANNOT ID no.1139571
  misc_feature: Encodes the peptide sequence at SEQ ID NO 240
atggcataccaaaatgaaccccaagagagctctcccctgaggaagctggggaggggaaaggtggagatcaagcggatcgagaacaccaccaatcgccaagtcactttctgcaaaaggcggaatggtttgctcaagaaagcctatgaattatctgttctttgcgatgctgaggttgcactcatcgtcttctccagccgtggacgcctttatgagtactctaacaatagtgtcaaatctacaattgaaaggtacaaaaaggcatgtgcagattcttccaacaacgggtcagtttctgaagccaatgctcagttttatcagcaagaagctgccaagctgcgctcgcaaattggtaatttgcagaattcaaacaggaatatgctgggtgaatcacttagtgcattgagtgtgaaggaacttaagagcttggagataaaacttgagaaaggaattggtagaattcgttcgaaaaagaatgagctgttgtttgctgaaattgagtatatgcagaagagggagattgacttgcacaacaataaccagcttctccgagcaaagattgcagagaatgaaagaaagcgacagcacatgaatttgatgccgggaggtgtcaacttcgagatcatgcagtctcaaccatttgactctcggaactattctcaagttaatggattgccgcctgccaatcattaccctcatgaagaccagctcttcagttag

SEQ ID NO: 240 - protein, 238 aa, Populus balsamifera subsp. trichocarpa
  misc_feature: Ceres ANNOT ID NO.1139571
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(238): Functional Homolog of  Ceres CLONE NO.22339 at SEQ ID NO.238 with e-value of 1.29E-71 and BLAST sequence identity of 68.75
MAYQNEPQESSPLRKLGRGKVEIKRIENTTNRQVTFCKRRNGLLKKAYELSVLCDAEVALIVFSSRGRLYEYSNNSVKSTIERYKKACADSSNNGSVSEANAQFYQQEAAKLRSQIGNLQNSNRNMLGESLSALSVKELKSLEIKLEKGIGRIRSKKNELLFAEIEYMQKREIDLHNNNQLLRAKIAENERKRQHMNLMPGGVNFEIMQSQPFDSRNYSQVNGLPPANHYPHEDQLFS

SEQ ID NO: 241 - DNA, 726 bp, Populus balsamifera subsp. trichocarpa
  misc_feature: Ceres ANNOT ID no.1139572
  misc_feature: Encodes the peptide sequence at SEQ ID NO 242
atggaatatcaaaatgaatcccttgagagctcccccctgaggaagctgggaaggggaaaggtggagatcaagcggatcgagaacaccaccaatcgccaagtcactttctgcaaaaggcgcagtggtttgctcaagaaagcctacgaattatctgttctttgcgatgctgaggttgcactcatcgtcttctctagccgcggtcgcctttatgagtactctaacgatagtgtcaaatcaacaattgagaggtacaaaaaggcatctgcagattcttcaaacactgggtctgtttctgaagccaatgctcagtactaccagcaagaagctgccaagctgcgttcccaaattggtaatttgcagaattcaaacaggcatatgctgggtgaagcgcttagttcattgagtgtgaaggaacttaagagtttggaaatacgacttgagaaaggaataagcagaattcgttccaaaaagaatgagctgttgtttgcagaaatcgagtatatgcagaagagggaggttgacttgcacaacaataaccagcttctccgagcaaagatttcagagaatgaaagaaagcgacagagcatgaatttgatgccaggaggagcagactttgagatcgtgcagtctcaaccatatgactctcggaactattctcaagtgaatggattacagcctgcaagtcattactcacatcaagatcagatggcccttcagttagtttaa

SEQ ID NO: 242 - protein, 241 aa, Populus balsamifera subsp. trichocarpa
  misc_feature: Ceres ANNOT ID NO.1139572
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(241): Functional Homolog of  Ceres CLONE NO.22339 at SEQ ID NO.238 with e-value of 8.80E-75 and BLAST sequence identity of 67.0
MEYQNESLESSPLRKLGRGKVEIKRIENTTNRQVTFCKRRSGLLKKAYELSVLCDAEVALIVFSSRGRLYEYSNDSVKSTIERYKKASADSSNTGSVSEANAQYYQQEAAKLRSQIGNLQNSNRHMLGEALSSLSVKELKSLEIRLEKGISRIRSKKNELLFAEIEYMQKREVDLHNNNQLLRAKISENERKRQSMNLMPGGADFEIVQSQPYDSRNYSQVNGLQPASHYSHQDQMALQLV

SEQ ID NO: 243 - DNA, 417 bp, Arabidopsis thaliana
  misc_feature: Ceres CLONE ID no.103400
  misc_feature: Encodes the peptide sequence at SEQ ID NO 244
aaaaccaaaacagaaaccaaaaacaaaaaataaagttgaagcagcagttaagtggtactgagataataagaatagtatctttaggccaatgaacaaattaactctctcataattcatcttcccatcctcacttctctttctttctgatcataattaatcttgctaagccagctagggcttatagaaatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgcctgaggtttggctcttggtcatcttctccactcgaggccgtctctacgagtacgccaacaacag

SEQ ID NO: 244 - protein, 248 aa, Arabidopsis thaliana
  misc_feature: Ceres CLONE ID NO.103400
  misc_feature (24)..(74): Pfam Name: SRF-TF Pfam Description: SRF-type transcription factor
  misc_feature (89)..(190): Pfam Name: K-box Pfam Description: K-box region
  misc_feature (1)..(248): Functional Homolog of  Ceres CLONE NO.22339 at SEQ ID NO.238 with e-value of 2.59E-20 and BLAST sequence identity of 92.5
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKRVKEIELQNDNMYLRSKITERTGLQQQESSVIHQGTVYESGVTSSHQSGQYNRNYIAVNLLEPNQNSSNQDQPPLQLV

SEQ ID NO: 245 - DNA, 1303 bp, Zea mays
  misc_feature: Ceres CLONE ID no.243227
  misc_feature: Encodes the peptide sequence at SEQ ID NO 246
cttgcttccgatggatcccatcccactgccatcctttctttcccttgcgcgcattgcctagccggccggccggcctgctatattaaaccactttaccccccctctcgctcacgctcgacgcagctcccttttccttgcttgcttattgcaagtctctgcaagaacctgctagagaggaacaagctggtatcgtcgccagcatgggtagaggaaggattgagatcaagaggatsgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacawtgcccagcaattctaccagcaagaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagctgccaccaacttggagcygaacccattcttggagatggataccaaatgcttcttcactggcggccccttcgcgacgctggacatgaagtgctttctccccggcagcttgcagcagatgctggaggcacagcagcgccagatgctcgccaccgagctgaacctcggctaccaactggcgccgcctggttctgacgctgccaacaataaccctcatcatcagttctaaactggatgcatgtacgagaagcttttcaagcgaactgtgaacggtggaagctggctgttgcctctagatgttcttggcttccatgacctagcttattgcggtgtgtattgttgttgccttttgtgtgtgattctccttgtgctactctacctgatggagaactaaacctaatcgattggacataatgatcaaatgctacagatcctgtgaggctgtgatcaggttaaggcaaaacaagtatactgattgcttaaatgggtttacgmgtgacgacaatgctatttgttgcttctatc

SEQ ID NO: 246 - protein, 268 aa, Zea mays
  misc_feature: Ceres CLONE ID NO.243227
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(268): Functional Homolog of  Ceres CLONE NO.22339 at SEQ ID NO.238 with e-value of 9.80E-60 and BLAST sequence identity of 68.9
MGRGRIEIKRIENNTSRQVTFCKRRNGLLKKAYELSVLCDAEVALIVFSSRGRLYEYANNSVKATVERYKKAHTVGSSSGPPLLEHNAQQFYQQESAKLRNQIQMLQNTNRHLVGDSVGNLSLKELKQLESRLEKGISKIRARKSELLAAEISYMAKRETELQNDHMTLRTKIEEGEQQLQQVTVARSVAAAAAATNLELNPFLEMDTKCFFTGGPFATLDMKCFLPGSLQQMLEAQQRQMLATELNLGYQLAPPGSDAANNNPHHQF

SEQ ID NO: 247 - DNA, 1321 bp, Zea mays
  misc_feature: Ceres CLONE ID no.246176
  misc_feature: Encodes the peptide sequence at SEQ ID NO 248
atcagtagtagtggccttttgcccttgcccctcatctctctcaccacctctcttttctcagccttgcttccgatggatcccatcccactgccatcctttctttcccttgcgcgcattgcctagccggccggccggcctgctatattaaaccactttaccccccctctcgctcacgctcgacgcagctcccttttccttgcttgcttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagctgccaccaacttggagctgaacccattcttggagatggataccaaatgcttcttcactggcggccccttcgcgacgctggacatgaagtgctttctccccggcagcttgcagcagatgctggaggcacagcagcgccagatgctcgccaccgagctgaacctcggctaccaactggcgccgcctggttctgacgctgccaacaataaccctcatcatcagttctaaactggatgcatgtacgagaagcttttcaagcgaactgtgaacggtggaagctggctgttgcctctagatgttcttggcttccatgacctagcttattgcggtgtgtattgttgttgccttttgtgtgtgattctccttgtgctactctacctgatggagaactaaacctaatcgattggacataatgatcaaatgctacagatcctgtgaggctgtgatcaggttaaggcaaaacaagtatactgattgcct

SEQ ID NO: 248 - protein, 268 aa, Zea mays; identical to SEQ ID NO: 246
  misc_feature: Ceres CLONE ID NO.246176
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(268): Functional Homolog of  Ceres CLONE NO.22339 at SEQ ID NO.238 with e-value of 9.80E-60 and BLAST sequence identity of 68.9

SEQ ID NO: 249 - DNA, 1104 bp, Glycine max
  misc_feature: Ceres CLONE ID no.1043518
  misc_feature: Encodes the peptide sequence at SEQ ID NO 250
atattttgcatcctttgtacctgagttcaaggttaacaccaaataacacatatagtgcagattcataagctttcaaccatggaggatccaaatcaagctcaagaagggtcttctcagaagaaaatgggaagagggaagattgaaatcaaacggatcgagaacaccaccaataggcaagtcaccttctgcaagcgccgcaacggtttgctgaagaaagcttatgaattatcagttctgtgtgatgcggaagttgcccttgttgtcttctcaacccgtggccgtttgtatgagtatgccaacaacagtgttagggccaccattgaaaggtacaagaaggcaaatgctgctgcttcaaacgcagaatccgtatctgaagctaacacacagttttaccagcaagagtcatccaaattgagaagacaaattcgagatattcagaatctaaacaggcacatccttggtgaagcacttggttctctgagtctcaaggaactaaagaacctcgagggtagattggagaaaggattaagcagagttagatctagaaagcatgaaacattgtttgctgatgtcgagttcatgcaaaagcgggaaattgagctgcaaaaccacaataattatctgcgagctaagatagctgaacatgagagagctcaacaacagcaatcaaatatgatgtcaggaacactgtgcgagtcccttccttcacaatcatacgacaggaattttttccctgtaaatctcatagcttctgatgatcaacaacaatattctagtcaagaccacactgctctccaacttgtctgatgatatgctggaaattagagctactggaagttctgccacagtcattatatatatatatatatcggttgatgtagctctagctatttgaatagttacgtgtagcacctatatagtgcagagcaaataatgccacacatgcatgcctgcgtttcctgaatcagtttgtgcctttagaattgacgttaatttgctaaaggtcattattagactgcgaacttataaatgatccattttggactcatatttcatacgatatatataatgttaatgtatcttttaataaaaaaaaaaaaaaaa

SEQ ID NO: 250 - protein, 242 aa, Glycine max
  misc_feature: Ceres CLONE ID NO.1043518
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(242): Functional Homolog of  Ceres CLONE NO.22339 at SEQ ID NO.238 with e-value of 4.79E-83 and BLAST sequence identity of 72.9
MEDPNQAQEGSSQKKMGRGKIEIKRIENTTNRQVTFCKRRNGLLKKAYELSVLCDAEVALVVFSTRGRLYEYANNSVRATIERYKKANAAASNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQSNMMSGTLCESLPSQSYDRNFFPVNLIASDDQQQYSSQDHTALQLV

SEQ ID NO: 251 - protein, 265 aa, Zea mays
  misc_feature: Public GI ID NO.1001935
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(265): Functional Homolog of  Ceres CLONE NO.22339 at SEQ ID NO.238 with e-value of 1.19E-59 and BLAST sequence identity of 70.1
MGRGRIEIKRIENNTSRQVTFCKRRNGLLKKAYELSVLCDAEVALVVFSSRGRLYEYANNSVKATIERYKKAHAVGSSSGPPLLEHNAQQFYQQESVKLRNQIQMLQNTNRHLVGDSVGNLSLKELKQLESRLEKGISKIRARKSELLAAEINYMAKRETELQNDHMNLRTKIEEGEQQLQQVTVAQSVAAAAATDVELNPFLEMDTKCFFPGGPFATLDMKCFFPGSLQMLEAQQRQMLATELNLGYQLAPPDTDVANNNPQQF

SEQ ID NO: 252 - protein, 234 aa, Hordeum vulgare subsp. vulgare
  misc_feature: Public GI ID NO.19698536
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(234): Functional Homolog of  Ceres CLONE NO.22339 at SEQ ID NO.238 with e-value of 2.29E-67 and BLAST sequence identity of 62.8
MGRGRIEIKRIENTTNRQVTFCKRRNGLLKKAYELSVLCDAEVALVVFSSRGRLYEYSNNSVKATIERYKKANSDTSNSGTVAEVNAQYYQQESSKLRQQISSLQNSNSRSLVRDSVSTMTLRDLKQLEGRLEKGIAKIRARKNELMYAEVEYMQKREMELHNDNIYLRSKVSENERGQQPMNMMASGSTSSEYDHMVAPYDSRNFLQVNMQQQQHYSQQLQPTALQLGQQYFN

SEQ ID NO: 253 - protein, 265 aa, Oryza sativa
  misc_feature: Public GI ID NO.50902252
  misc_feature (74)..(175): Pfam Name: K-box Pfam Description: K-box region
  misc_feature (9)..(59): Pfam Name: SRF-TF Pfam Description: SRF-type transcription factor
  misc_feature (1)..(265): Functional Homolog of  Ceres CLONE NO.22339 at SEQ ID NO.238
MGRGKIEIKRIENKTSRQVTFCKRRNGLLKKAYELAILCDAEIALIVFSSRGRLYEFSNVNSTRSTIERYKKASASTSGSAPVIDVNSHQYFQQEAAKMRHQIQTLQNANRHLIGESIGNMTAKELKSLENRLEKGISRIRSKKHELLFSEIEYMQKREADLQNENMFLRAKVAEAERAEHDDQQAAEDDEMAPAPAVGGGSSSGTELEALPATFDTREYYQPAPPVSMLAAAAAAAAAQYSSDHHQTALHLGYFKVDSGKGGLL

SEQ ID NO: 254 - protein, 247 aa, Petunia x hybrida
  misc_feature: Public GI ID NO.396199
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(247): Functional Homolog of  Ceres CLONE NO.22339 at SEQ ID NO.238 with e-value of 5.80E-78 and BLAST sequence identity of 70.7
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRGLKNLEGKLEKAIGRVRSKKNELLFSEIELMQKREIEMQNANMYLRAKIAEVERATQQMNLMHGGGSEYQQQPMSSTSQPYDARNFLPVNLLEPNPHYSRQDQTALQLV

SEQ ID NO: 255 - protein, 247 aa, Petunia integrifolia subsp. inflata
  misc_feature: Public GI ID NO.848999
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(247): Functional Homolog of  Ceres CLONE NO.22339 at SEQ ID NO.238 with e-value of 2.20E-78 and BLAST sequence identity of 70.7
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRDLKNLEGKLEKAIGRVRSKKNELLFSEIELMQKREIEMQNANMYLRAKIAEVERATQQMNLMPGGGSEYQQQPMSSTSQPYDARNFLPVNLLEPNPHYSRQDQTALQLV

SEQ ID NO: 256 - protein, 268 aa, Zea mays; identical to SEQ ID NO: 246
  misc_feature: Public GI ID NO.1001934
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(268): Functional Homolog of  Ceres CLONE NO.22339 at SEQ ID NO.238

SEQ ID NO: 257 - protein, 259 aa, Zea mays
  misc_feature: Public GI ID NO.2529340
  misc_feature (106)..(206): Pfam Name: K-box Pfam Description: K-box region
  misc_feature (41)..(91): Pfam Name: SRF-TF Pfam Description: SRF-type transcription factor
  misc_feature (1)..(259): Functional Homolog of  Ceres CLONE NO.22339 at SEQ ID NO.238 with e-value of 8.00E-65 and BLAST sequence identity of 64.4
MLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAIIKIRARKNELLYAEVDYMQKREMDLQTDNMYLRSKIAESNETGQPAMHMTMGAPPTSEYDHMAPFDSRNFLQVSMPQHYSHQLQPTTLQLG

SEQ ID NO: 258 - protein, 241 aa, Populus balsamifera subsp. trichocarpa; identical to SEQ ID NO: 242
  misc_feature: Public GI ID NO.2981131
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(241): Functional Homolog of  Ceres CLONE NO.22339 at SEQ ID NO.238 with e-value of 8.80E-75 and BLAST sequence identity of 67.0

SEQ ID NO: 259 - protein, 238 aa, Populus balsamifera subsp. trichocarpa; identical to SEQ ID NO: 240
  misc_feature: Public GI ID NO.2981133
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(238): Functional Homolog of  Ceres CLONE NO.22339 at SEQ ID NO.238 with e-value of 1.29E-71 and BLAST sequence identity of 68.75

SEQ ID NO: 260 - protein, 248 aa, Lycopersicon esculentum
  misc_feature: Public GI ID NO.3913004
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(248): Functional Homolog of  Ceres CLONE NO.22339 at SEQ ID NO.238 with e-value of 2.80E-78 and BLAST sequence identity of 66.6
MDFQSDLTREISPQRKLGRGKIEIKRIENTTNRQVTFCKRRNGLLKKAYELSVLCDAEVALVVFSNRGRLYEYANNSVKATIERYKKACSDSSNTGSVSEANAQYYQQEASKLRAQIGNLMNQNRNMMGEALAGMKLKELKNLEQRIEKGISKIRSKKNELLFAEIEYMQKREVDLHNNNQYLRAKIAETERAQHQHQQMNLMPGSSSNYHELVPPPQQFDTRNYLQVNGLQTNNHYPRQDQPPIQLV

SEQ ID NO: 261 - protein, 246 aa, Gerbera hybrid cv. 'Terra Regina'
  misc_feature: Public GI ID NO.4218162
  misc_feature (24)..(74): Pfam Name: SRF-TF Pfam Description: SRF-type transcription factor
  misc_feature (86)..(192): Pfam Name: K-box Pfam Description: K-box region
  misc_feature (1)..(246): Functional Homolog of  Ceres CLONE NO.22339 at SEQ ID NO.238 with e-value of 3.70E-76 and BLAST sequence identity of 67.7
MSFPNDSGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLESKLEKGIGKIRSKKNEILFAEIEYMQKRENELHNSNQFLRSKIAENERAQQHMSLMPGSSDYELVAPHQPFDGRNYLQVNDLQPNNNYSCQDQTPLQLV

SEQ ID NO: 262 - protein, 246 aa, Antirrhinum majus
  misc_feature: Public GI ID NO.4837612
  misc_feature (25)..(75): Pfam Name: SRF-TF Pfam Description: SRF-type transcription factor
  misc_feature (90)..(190): Pfam Name: K-box Pfam Description: K-box region
  misc_feature (1)..(246): Functional Homolog of  Ceres CLONE NO.22339 at SEQ ID NO.238 with e-value of 1.40E-76 and BLAST sequence identity of 67.9
MASLSDQSTEVSPERKIGRGKIEIKRIENKTNQQVTFCKRRNGLLKKAYELSVLCDAEVALVVFSSRGRLYEYANNSVKATIDRYKKASSDSSLNGSISEANTQYYQQEASKLRAQISNLQNQNRNMLGESLGALSLRELKNLESRVERGISRIRSKKNELLFAEIEYMQKRQEIDLHHNNQYLRAKIAESERVQGQHMNLMPGGSSGYEQLVETQPFDARNYLQVNGLQPNNDYPRQDQLPLQLV

SEQ ID NO: 263 - protein, 228 aa, Hyacinthus orientalis
  misc_feature: Public GI ID NO.4887235
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(228): Functional Homolog of  Ceres CLONE NO.22339 at SEQ ID NO.238 with e-value of 8.09E-72 and BLAST sequence identity of 68.1
MGRGKIEIKRIENTTSRQVTFCKRRNGLLKKAYELSVLCDAEVALIVFSTRGRLYEYSNSNSVKTTIERYKKACTDTTNTGTVSEANSQYYQQEATKLRQQITNLQNTNRTLMGESLSTMSLRELKQLEGRLERGINKIRTKKNELLSAEIEYMQKREAEMHNDNMYLRNKIAENERAQQQMNMLPSTATEYEGIPQFDSRNFLQVSLMEPNNHHYSRQQQQTALQLG

SEQ ID NO: 264 - protein, 244 aa, Liquidambar styraciflua
  misc_feature: Public GI ID NO.5031217
  misc_feature (28)..(78): Pfam Name: SRF-TF Pfam Description: SRF-type transcription factor
  misc_feature (92)..(191): Pfam Name: K-box Pfam Description: K-box region
  misc_feature (1)..(244): Functional Homolog of  Ceres CLONE NO.22339 at SEQ ID NO.238 with e-value of 3.59E-85 and BLAST sequence identity of 76.0
LATTEFPNQSSEGSSSQKKMGRGKIEIKRIENTTNRQVTFCKRRNGLLKKAYELSVLCDAEIALIVFSSRGRLYEYANNSVKSTIERYKKASDTSNPGSVSETNAQFYQQESSKLRRQIRDIQNLNRHIMGEALSSLTFRELKNLEGRLEKGISRIRSKKNELLFAEIEYMQKREIELQNANMYLRAKIAENERNQQQTELMPGSVYETMPSSQPYDRSFLVANLLEPPNHHYSRQDQTPLQLV

SEQ ID NO: 265 - protein, 249 aa, Brassica napus
  misc_feature: Public GI ID NO.12655901
  misc_feature (1)..(249): Functional Homolog of  Ceres CLONE NO.22339 at SEQ ID NO.238 with e-value of 6.49E-118 and BLAST sequence identity of 92.7
MDEGGSSHDAESSKKIGRGKIEIKRIENTTNRQVTFCKRRNGLLKKAYELSVLCDAEVALVIFSTRGLLYEYASNSVKGTIERYKKACSDAVNPPTVTEANTKHYQQEASKLRRQIRDIQNSNRHIVGESLGSLNFKELKNLEGRLEKGISRVRSKKSELLVAEIEYMQKREMELQHVNMYLRAKIEQGARLNPEQHGSGVIQGTAVYESGLSSSHDQSQHYNRNYIPVNLLEPNQQFSGQDQPPLQLV

SEQ ID NO: 266 - protein, 225 aa, Vitis vinifera
  misc_feature: Public GI ID NO.14279306
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(225): Functional Homolog of  Ceres CLONE NO.22339 at SEQ ID NO.238 with e-value of 4.30E-82 and BLAST sequence identity of 75.5
MGRGKIEIKRIENTTNRQVTFCKRRNGLLKKAYELSVLCDAEVALIVFSSRGRLYEYANNSVRTTIERYKKVCSDSSNTGSVSEANAQFYQQEASKLRRQIRDIQNLNRHILGEALSSLNFKELKNLETRLEKGISRIRSKKNELLFAEIEYMQKREIELQNSNLFLRAQIAENERAQQQMNLMPGSQYESVPQQPYDSQNLLPVNLLDPNHHYSRHDQTALQLV

SEQ ID NO: 267 - protein, 242 aa, Malus x domestica
  misc_feature: Public GI ID NO.16973296
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(242): Functional Homolog of  Ceres CLONE NO.22339 at SEQ ID NO.238 with e-value of 3.69E-83 and BLAST sequence identity of 70.6
MEFANQAPESSTQKKLGRGKIEIKRIENTTNRQVTFCKRRNGLLKKAYELSVLCDAEVALIVFSTRGRLYEYANNSVRATIDRYKKACADSTDGGSVSEANTQFYQQEASKLRRQIREIQNSNRHILGESLSTLKVKELKNLEGRLEKGISRIRSKKNEILFSEIEFMQKRETELQHHNNFLRAKIAESEREQQQQQTHMIPGTSYDPSMPSNSYDRNFFPVILESNNNHYPRQGQTALQLV

SEQ ID NO: 268 - protein, 249 aa, Brassica napus; identical to SEQ ID NO: 265
  misc_feature: Public GI ID NO.17223670
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(249): Functional Homolog of  Ceres CLONE NO.22339 at SEQ ID NO.238

SEQ ID NO: 269 - protein, 239 aa, Phalaenopsis equestris
  misc_feature: Public GI ID NO.18650789
  misc_feature (20)..(70): Pfam Name: SRF-TF Pfam Description: SRF-type transcription factor
  misc_feature (85)..(184): Pfam Name: K-box Pfam Description: K-box region
  misc_feature (1)..(239): Functional Homolog of  Ceres CLONE NO.22339 at SEQ ID NO.238 with e-value of 1.40E-74 and BLAST sequence identity of 65.1
MDSSSMEPKEKMGRGKIEIKRIENTTNRQVTFCKRRNGLLKKAYELSVLCDAEVALIIFSTRGRLYEYANNSVKGTIERYKKASTDNSNTGSISEANSQYYQQEATKLRQQITNLQNSNRNLLGDALTTMSLRDLKQLETRLEKGINKIRAKKNELLHAEIDYMQKREMELQTDNMFLRNKISDNERAQQQHQHMSILPSTSTEYEVMPPFDSRSFLHVNLMDPNDRYSHQQQTALQLG

SEQ ID NO: 270 - protein, 244 aa, Gossypium hirsutum
  misc_feature: Public GI ID NO.19743774
  misc_feature (24)..(74): Pfam Name: SRF-TF Pfam Description: SRF-type transcription factor
  misc_feature (88)..(187): Pfam Name: K-box Pfam Description: K-box region
  misc_feature (1)..(244): Functional Homolog of  Ceres CLONE NO.22339 at SEQ ID NO.238 with e-value of 2.80E-71 and BLAST sequence identity of 71.0
MVYPNESLEDSPQKKMGRGKIEIKRIENTTNRQVTFCKRRNGLLKKAYELSVLCDAEVALVAFSSRGRLYEYANNSVKATIERYKKASDSSNTGSVAEVNAQFYQQEADKLRNQIRNLQNANRHMLGESIGGLPMKELKSLESRLEKGISRIRSKKNELLFAEIEYMQKREIDLHNNNQLLRAKIAENERKQQSMNLMPGGSSANFEALHSQPYDSRNYFQVDALQPATNYYNPQLQQDQIALH

SEQ ID NO: 271 - protein, 258 aa, Arabidopsis thaliana
  misc_feature: Public GI ID NO.25307910
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(258): Functional Homolog of  Ceres CLONE NO.22339 at SEQ ID NO.238 with e-value of 1.49E-104 and BLAST sequence identity of 86.8
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLRDLIIYIYLDYVS

SEQ ID NO: 272 - protein, 248 aa, Arabidopsis thaliana; identical to SEQ ID NO: 244
  misc_feature: Public GI ID NO.30689162
  misc_feature (24)..(74): Pfam Name: SRF-TF Pfam Description: SRF-type transcription factor
  misc_feature (89)..(190): Pfam Name: K-box Pfam Description: K-box region
  misc_feature (1)..(248): Functional Homolog of  Ceres CLONE NO.22339 at SEQ ID NO.238 with e-value of 8.10E-104 and BLAST sequence identity of 86.8

SEQ ID NO: 273 - protein, 242 aa, Malus x domestica
  misc_feature: Public GI ID NO.33308109
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(242): Functional Homolog of  Ceres CLONE NO.22339 at SEQ ID NO.238 with e-value of 1.30E-82 and BLAST sequence identity of 71.3
MEFPNQAPESSSQKKLGRGKIEIKRIENTTNRQVTFCKRRNGLLKKAYELSVLCDAEVALIVFSNRGRLYEYANNSVRATIDRYKKAYADPTNSGSVSEANTQFYQQEASKLRRQIREIQNSNRHILGEALSSLNAKELKNLEGRLEKGISRIRSKKNEMLFSEIEFMQKRETELQHHNNFLRAKIAENEREEQQHTHMMPGTSYDQSMPSHSYDRNFLPAVILESNNNHYPHQVQTALQLV

SEQ ID NO: 274 - protein, 244 aa, Ipomoea nil
  misc_feature: Public GI ID NO.37359697
  misc_feature (26)..(76): Pfam Name: SRF-TF Pfam Description: SRF-type transcription factor
  misc_feature (91)..(190): Pfam Name: K-box Pfam Description: K-box region
  misc_feature (1)..(244): Functional Homolog of  Ceres CLONE NO.22339 at SEQ ID NO.238 with e-value of 3.10E-79 and BLAST sequence identity of 70.8
MEFPNQALEEEESSHRKSGRGKIEIKRIENTTNRQVTFCKRRNGLLKKAYELSVLCDAEVALIVFSTRGRLYEYANNSVRATIDRYKKHHSDSTNTGSVSEANTQFYQQESAKLRRQIREIQTSNKQILGESLGVLNHKELKNLEGKVEKAIGRVRSKKNELLFSEIELMQKREIELQNANMYLRAKISEFERAQQQMNLMPGSEYQETMTTSQTYDAHNFLPLTLLEPNQHYSRHDQTALQLV

SEQ ID NO: 275 - protein, 226 aa, Asparagus virgatus
  misc_feature: Public GI ID NO.46917358
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(226): Functional Homolog of  Ceres CLONE NO.22339 at SEQ ID NO.238 with e-value of 1.19E-77 and BLAST sequence identity of 70.9
MGRGKIEIKRIENTTNRQVTFCKRRNGLLKKAYELSVLCDAEVALIVFSSRGRLYEYANNSVKATIERYKKACTDTTNTGTVSEANSQYYQQEASKLRQQITNLQNSNRNLMGESLSSMGLRDLKQLESRLEKGISKIRSKKNELLYAEIEYMQKREMELQNDNMYLRNKIAENERAQQQMNMLPAATSNEYEGMPQFDSRNFLQVNLLDPNHHYSQQQQTALQLG

SEQ ID NO: 276 - protein, 245 aa, Akebia trifoliata
  misc_feature: Public GI ID NO.48727610
  misc_feature (29)..(79): Pfam Name: SRF-TF Pfam Description: SRF-type transcription factor
  misc_feature (94)..(193): Pfam Name: K-box Pfam Description: K-box region
  misc_feature (1)..(245): Functional Homolog of  Ceres CLONE NO.22339 at SEQ ID NO.238 with e-value of 1.80E-76 and BLAST sequence identity of 69.0
MCILITDFPNRSSNNSPQRKMGRGKIEIKRIENTTNRQVTFCKRRNGLLKKAYELSVLCDAEVALVVFSNRGRLYEYSNNSVKTTIERYKKACVDSSNSGSVSEANAQFYQQESLKLRQQIGNLQNLNRHLMGEALGSMSIKELKQLETRIEKGISRIRSKKNELLFAEIEYMQKREIDLQNDNMYLRAKIAENERAGQHMNLMPGNEYEVMSSAPFDSRNFLQVNLLEPNNHYSHTDQTALQLG

SEQ ID NO: 277 - protein, 246 aa, Arabidopsis thaliana
  misc_feature: Public GI ID NO.52548134
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(246): Functional Homolog of  Ceres CLONE NO.22339 at SEQ ID NO.238 with e-value of 2.10E-105 and BLAST sequence identity of 86.1
MEDGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 278 - protein, 246 aa, Arabidopsis thaliana
  misc_feature: Public GI ID NO.52548150
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(246): Functional Homolog of  Ceres CLONE NO.22339 at SEQ ID NO.238
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 279 - protein, 246 aa, Arabidopsis thaliana
  misc_feature: Public GI ID NO.52548152
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(246): Functional Homolog of  Ceres CLONE NO.22339 at SEQ ID NO.238 with e-value of 1.49E-104 and BLAST sequence identity of 86.4
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTAYESGVTSSHQSGQYNRNYIAVNLLEPNQNSSNQDQPPLQLV

SEQ ID NO: 280 - protein, 224 aa, Elaeis guineensis
  misc_feature: Public GI ID NO.58201611
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(224): Functional Homolog of  Ceres CLONE NO.22339 at SEQ ID NO.238 with e-value of 2.59E-75 and BLAST sequence identity of 69.5
MGRGKIEIKRIENTTNRQVTFCKRRNGLLKKAYELSVLCDAEVALIIFSSRGRLYEYANNSVKATIERYKKACTDTSNSGSVSEADSQYYQQESLKLRQQITSLQNSNRNLMGDSLGSMSLRDLKQLEGRLEKGINKIRTKKNELLFAEIEYMQKRETELQNANMYLRNKIAENEGAQQQMNMLPATTEYEVMPPYDSRNFLQVNLMQSNQHYSHQQQTALQLG

SEQ ID NO: 281 - protein, 241 aa, Pisum sativum
  misc_feature: Public GI ID NO.62132641
  misc_feature (24)..(74): Pfam Name: SRF-TF Pfam Description: SRF-type transcription factor
  misc_feature (87)..(188): Pfam Name: K-box Pfam Description: K-box region
  misc_feature (1)..(241): Functional Homolog of  Ceres CLONE NO.22339 at SEQ ID NO.238 with e-value of 6.09E-83 and BLAST sequence identity of 75.3
MELPNEGGEGSSQKKLGRGKIEIKRIENTTNRQVTFCKRRNGLLKKAYELSVLCDAEVALVVFSTRGRLYEYANNSVRATIERYKKACAASTNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQQNLMPETMCESLPSQTYDRNFFPVNLLGSDQQEYSRQDQTALQLV

SEQ ID NO: 282 - protein, 247 aa, Misopates orontium
  misc_feature: Public GI ID NO.82734193
  misc_feature (25)..(75): Pfam Name: SRF-TF Pfam Description: SRF-type transcription factor
  misc_feature (90)..(190): Pfam Name: K-box Pfam Description: K-box region
  misc_feature (1)..(247): Functional Homolog of  Ceres CLONE NO.22339 at SEQ ID NO.238 with e-value of 2.30E-76 and BLAST sequence identity of 67.9
MASLSDQSTEVSPERKIGRGKIEIKRIENTTNRQVTFCKRRNGLLKKAYELSVLCDAEIALVVFSSRGRLYEYANNSVKETIDRYKKASSDSSLNGSISEANTQYYQQEASKLRAQISNLQNQNRNMLGESLGALSLRELKNLESRVERGISRIRSKKNELLFAEIEYMQKRQEIDLHHNNQYLRAKIAESERVQGQHMNLMPGGSSGFEQLVETQPFDARNYLQVNGLQQPNNDYPRQDQLPLQLV

SEQ ID NO: 283 - protein, 238 aa, Misopates orontium
  misc_feature: Public GI ID NO.82734201
  misc_feature (20)..(70): Pfam Name: SRF-TF Pfam Description: SRF-type transcription factor
  misc_feature (84)..(184): Pfam Name: K-box Pfam Description: K-box region
  misc_feature (1)..(238): Functional Homolog of  Ceres CLONE NO.22339 at SEQ ID NO.238 with e-value of 4.70E-76 and BLAST sequence identity of 69.5
MEFPNQDSERKNGRGKIEIKRIENTTNRQVTFCKRRNGLLKKAYELSVLCDAEVALVVFSSRGRLYEYANNSVRATIDRYKKASADSSNSVSTSEANTQFYQQEANKLRRQIREIQTSNRQMLGEGVGNMALKDLKSTEAKVEKAISRIRSKKNELLFAEIELMQKRELELHNANMFLRAKIAEGERAQQQQMNLMPGSDYQPMTSQSYDVRNFLPMNLMEPNQQQYSRHDQTALQLV

SEQ ID NO: 284 - DNA, 873 bp, Arabidopsis thaliana
  misc_feature: Ceres CLONE ID no.13660
  misc_feature: Ceres LOCUS ID At5g25210
  misc_feature: Encodes the peptide sequence at SEQ ID NO 285
agtatctcagtacctttacgctttgtttgtctctatcttcttcctgatattcagagaatggtttcatcagatgattggacgaagtgtgcgatgagagatggagaagtggtggcagagcttttggtgaagcttaaagaagccaaagtaatcaagaatccgattgtaacagcgctccggtggggaatccaacagccaaggtctcggtgtccaagaaaagaatctgaatctagatgtagtccaagtacaccactatcttggagtggttgttgtggtggttcttcttcttctccatctggttatgtcgatggttacgaagctactagtcgtcaaatcagtgccgttggatctagatccaagaacatttcatcacttagatcaccattcagcgagcgaggcatcgagaataataacttgaagagaatgaagatgaatcatattcagaatttggcaaaggatgagaattgcaagacagatggcaatttcttgctaccagatttgaatatagtgccatgtgacgaaaatagtgaccactatacgtctttaggtgtggaaacaacactatatgggataaggattataaggtgaaagaagctcacttaatccatgagaaagtggttttgagaatgtttaagctgatctgatcatctttgactcggctttttaaaagggttcgcgccacgcatgagctcgaaaagacaaagagtataaattcctcaaggaagtttcctttgtgtggtggttctatatatgaagatcatcagcaaatgtgtaagatagataaaacaaagagaagaatataatttctggttgtttctttgtagcaataacaaaaacagatattttgtattgattgtctatatttgcacaagtggt

SEQ ID NO: 285 - protein, 175 aa, Arabidopsis thaliana
  misc_feature: Ceres CLONE ID NO.13660
  misc_feature: Ceres LOCUS ID At5g25210
MVSSDDWTKCAMRDGEVVAELLVKLKEAKVIKNPIVTALRWGIQQPRSRCPRKESESRCSPSTPLSWSGCCGGSSSSPSGYVDGYEATSRQISAVGSRSKNISSLRSPFSERGIENNNLKRMKMNHIQNLAKDENCKTDGNFLLPDLNIVPCDENSDHYTSLGVETTLYGIRIIR

SEQ ID NO: 286 - DNA, 582 bp, Populus balsamifera subsp. trichocarpa
  misc_feature: Ceres ANNOT ID no.1508840
  misc_feature: Encodes the peptide sequence at SEQ ID NO 287
atggaggagtgggtgacagcggcgatggcagacgagacagtagtagcaaaactactactgcgcctcaaacaatcacaggcgacggcatcagcttccgcggtgccagcggttattcccttgcgatgggggatgcggcttccgaggtcaaggccgggaacgatgacagcaacgaattcttcttcattgagatgcgatgtcgttttgaaaagtaaggaaggcggcggcggcgattcctctactagatgcagtcctaccactcctctttcatggagcggtggtggtgatggtggtgcttctccgtccggtactggtgacggttttgaagaaaccagccgccgccacctcagcagttctcctccgccacctggcgttagatccaagggtgctggtattggtgaaaccactagcaatatagtgaagaggtcaagaaaaaagaagactttttctgaacttaaagaggaggaaacgcagctagtgaaggaaggggtttatcttaaaaaggagatatcaactgtacgtgcaacatttaaggaggagagagctagaaatgagaatttgaagagaattaagggactgagttga

SEQ ID NO: 287 - protein, 193 aa, Populus balsamifera subsp. trichocarpa
  misc_feature: Ceres ANNOT ID NO.1508840
  misc_feature (1)..(193): Functional Homolog of  Ceres CLONE NO.13660 at SEQ ID NO.285 with e-value of 2.90E-12 and BLAST sequence identity of 39.8
MEEWVTAAMADETVVAKLLLRLKQSQATASASAVPAVIPLRWGMRLPRSRPGTMTATNSSSLRCDVVLKSKEGGGGDSSTRCSPTTPLSWSGGGDGGASPSGTGDGFEETSRRHLSSSPPPPGVRSKGAGIGETTSNIVKRSRKKKTFSELKEEETQLVKEGVYLKKEISTVRATFKEERARNENLKRIKGLS

SEQ ID NO: 288 - DNA, 549 bp, Glycine max
  misc_feature: Ceres CLONE ID no.474233
  misc_feature: Encodes the peptide sequence at SEQ ID NO 289
atcttttcctccaatacctcctccacccctttctttctctctctctctctctctctctctctcgattatttccctttgatgagtgttgaacggccaagatggtaaacgaagacgagtgggtgcgagcggcgatggcggacgacaccgtcgtggtggagcttctgctacgcctcaagcaaggtaccgtttcacacaaatctcaccaccagcttatacctttctcctggggtgtcaaacagccgcgctcaagatcaaggcttagcgccgccgtctctcgctgcgacgccgccgtttcaaccagatgcagccccaccacgcccctctcttggagcgctggcaccgacagttacgaagactccagccgscaccaccaccaccacgccgscatatctaaggctactgctacaagtggatacactggcaactctgcttctaccaagaggtgcagaagaaaaaagacctttgcagaattaaaggaagaggagagctcccttttmmmggaaagcatatatctgaaaaaggaaatagcaactgtaaatgcaaattttg

SEQ ID NO: 289 - protein, 150 aa, Glycine max
  misc_feature: Ceres CLONE ID NO.474233
  misc_feature (1)..(150): Functional Homolog of  Ceres CLONE NO.13660 at SEQ ID NO.285
  misc_feature (89)..(89): Xaa is any aa, unknown, or other
  misc_feature (96)..(96): Xaa is any aa, unknown, or other
  misc_feature (133)..(133): Xaa is any aa, unknown, or other
  misc_feature (134)..(134): Xaa is any aa, unknown, or other
MVNEDEWVRAAMADDTVVVELLLRLKQGTVSHKSHHQLIPFSWGVKQPRSRSRLSAAVSRCDAAVSTRCSPTTPLSWSAGTDSYEDSSXHHHHHAXISKATATSGYTGNSASTKRCRRKKTFAELKEEESSLXXESIYLKKEIATVNANF

SEQ ID NO: 290 - DNA, 1356 bp, Glycine max
  misc_feature: Ceres CLONE ID no.745881
  misc_feature: Encodes the peptide sequence at SEQ ID NO 291
ttttttcctccaatacctcctccacccctttctttctctctctctctctctctctctctctcgattatttccctttgatgagtgttgaacggccaagatggtaaacgaagacgagtgggtgcgagcggcgatggcggacgacaccgtcgtggtggagcttctgctacgcctcaagcaaggtaccgtttcacacaaatctcaccaccagcttatacctttctcctggggtgtcaaacagccgcgctcaagatcaaggcttagcgccgccgtctctcgctgcgacgccgccgtttcaaccagatgcagccccaccacgcccctctcttggagcgctggcaccgacagttacgaagactccagccgccaccaccaccaccacgccgccatatctaaggctactgctacaagtggatacactggcaactctgcttctaccaagaggtgcagaagaaaaaagacctttgcagaattaaaggaagaggagagctcccttctaaaggaaagcatatatctgaaaaaggaaatagcaactgtaaatgcaaattttgaggcacagagagctaaaaatgagagtctgaagagaatgaagcttgatgtgggattaaaatatcatcagaacaatccaagttcaacatctgttgaaccgcagtgtgtgcttgctggtcaaccccatcagagaatagtagtatcttcggaggccctcatacgtcccattcaagatgatactcattcacatgcatcagaatctaggccaaacaagatagaatcaaccaccgggaaaagttttttcttgataccagatctaaatatgatgccgtccgaggatgtttcttgcactgacaatctatgtggaatgagttgagacgacctttctctcttactatatgtgttggggatacaaatctgaacaatgtacaggccaagagagcattttgaaggctctgtccaatagaaaacctatggaaaacgtgttgggtgcactattaacgtttcttggtgtgactactaattcttatgaatggaaaagaaattggtagtcatatatatgggaaaattttcttgggtagttctagccattatgctgtagagtagagagatatgctaaggttgcaggttccttcgattccgaaatttcttaaaaacctttccgatttcggaattcttcaatcatgtcaggtgtaccattcttttgtaggttaaaagctcttggattcccttagaaggtatcttaaatctaaatattcatcgatttccatctgttacttcttcatttctttttatctacaagcaagtcgtgtgtcacctcttcgatataatgtatatgatgtttttcttggtttaaaaaaaaaaaaaaaa

SEQ ID NO: 291 - protein, 254 aa, Glycine max
  misc_feature: Ceres CLONE ID NO.745881
  misc_feature (1)..(254): Functional Homolog of  Ceres CLONE NO.13660 at SEQ ID NO.285 with e-value of 4.69E-17 and BLAST sequence identity of 39.8
MVNEDEWVRAAMADDTVVVELLLRLKQGTVSHKSHHQLIPFSWGVKQPRSRSRLSAAVSRCDAAVSTRCSPTTPLSWSAGTDSYEDSSRHHHHHAAISKATATSGYTGNSASTKRCRRKKTFAELKEEESSLLKESIYLKKEIATVNANFEAQRAKNESLKRMKLDVGLKYHQNNPSSTSVEPQCVLAGQPHQRIVVSSEALIRPIQDDTHSHASESRPNKIESTTGKSFFLIPDLNMMPSEDVSCTDNLCGMS

SEQ ID NO: 292 - DNA, 639 bp, Parthenium argentatum
  misc_feature: Ceres CLONE ID no.1603950
  misc_feature: Encodes the peptide sequence at SEQ ID NO 293
atcaccctattactatttcacatctcatcttcttctccactctctctctctaacctctttctctctctacacgaacaataacaaacacaaaacaacagatgacgaaagaacggtggatacaatcagcgttaactaacgacgagctggtggcggaccttctgctacgtctaaaacaacactcttcagatttagattcagattcgttattaataaagaaaacggttacaacgacgattattgttccgccttgttgggggaatcggaagactcgatcgaaatcaacggctgttgttaaaggatttggtaaagaacaccgtggtagtcccaccacgcatctgtcgtggagcggtggtggtggttcgagtagtgattgtagtcgtccgtcagatatgtcctctggttgtagatctgttaaggcaaatgaaggaccatcaatatccagctacaacaatttggatcaaaaccatagaaacaagatgagaaagatggaattatgtagcgaaaaagcggaaaccgagggaccgagaagggggtttgtattgcccgatttgaacatgacaccgaatgaggacgatatgtcgatgatggtgatgatatgagaatgaatgaagatcaagaaagatttctttatgtttctga

SEQ ID NO: 293 - protein, 166 aa, Parthenium argentatum
  misc_feature: Ceres CLONE ID NO.1603950
  misc_feature (1)..(166): Functional Homolog of  Ceres CLONE NO.13660 at SEQ ID NO.285 with e-value of 4.99E-8 and BLAST sequence identity of 34.5
MTKERWIQSALTNDELVADLLLRLKQHSSDLDSDSLLIKKTVTTTIIVPPCWGNRKTRSKSTAVVKGFGKEHRGSPTTHLSWSGGGGSSSDCSRPSDMSSGCRSVKANEGPSISSYNNLDQNHRNKMRKMELCSEKAETEGPRRGFVLPDLNMTPNEDDMSMMVMI

SEQ ID NO: 294 - DNA, 1427 bp, Glycine max
  misc_feature: Ceres CLONE ID no.1621236
  misc_feature: Encodes the peptide sequence at SEQ ID NO 295
aactcgaatctactccatcttccaccttcctccttcctcacccccacacaatatcctcaccccttcgctcattttttctttttattattaaaactaaaattatactagtatataaacctatgctcattccactctttatcttttcctccaatacctccgccaccactctctctctctctctctctctctcttcaatactcacgctagattatttccctttgatgagtgttgaacggccaagatggtgaacgacgacgagtgggtgcgtgcggcgatggaggatgacaccgttgtggtggagcttctgctacgcctcaagcaaggtaccgttttacacaaatctcaccaccagcagcttttacctttctcctggggagtcaaacagccgcgctcaagatcaaggctaacctccgccgccgtctcccgatgcgacgccgccgtttccaccagatgcagccccaccacgcccctctcttggagcgccggcgccgacagttacgaagactccagccgccaccaccaccatcacgccgccgtatccaaggctactgctacaagtggatacactggcaactctgcttctaccaagaggtgcagaagaaaaaagacctttgcagaattaaaggaagaggagagctccctgctaaaggaaagcatatatctgaaaaaggaaatagcgtctgtaaatgcaaactttgaggcacagagagctaaaaatgagagtctgaagagaatgaagcttgatgtgggatcaaaatatcagaacaatccaagttcaacatctgttgaaccgcagcgtctgcctgctggtcaaccccatcagagaatagtggtatctacggaggccctcatacgtcccattcaagaagatactcattcacttgcatcagaatctaggccaaacaggataaaatcaaccggggaaagttttttcttgataccagatctaaatatggtgccgtccgaggatgtttcttgcactgacgctctatgtggaatgagttgagacctctttctcttactatgtgtgttggggatacaaatctgaacaatgtacaggcccagagagctatttgaaggctctatccaatagaaaaccaatgaatatcgtggtgcactagaaacgtttcttgatctgactactaattcttatgaatggaaaagaaattggtagtcatatatatgggaaaattttcttgggtagttctagccattaggctgtagagtagagagatatgctaaaaagttcgcaggttcctccgattccgaaattcttaaaaacctttccgatttcggaattcgtcaatcatgtcagatgtaccaattcttttgtaggttaaacgctcttggattcccttagaaggtatctaaaatctaaaatcaatatacaattttatatttttattcaaaaaaaaaaaaaaaaaaaa

SEQ ID NO: 295 - protein, 254 aa, Glycine max
  misc_feature: Ceres CLONE ID NO.1621236
  misc_feature (1)..(254): Functional Homolog of  Ceres CLONE NO.13660 at SEQ ID NO.285 with e-value of 9.20E-14 and BLAST sequence identity of 39.8
MVNDDEWVRAAMEDDTVVVELLLRLKQGTVLHKSHHQQLLPFSWGVKQPRSRSRLTSAAVSRCDAAVSTRCSPTTPLSWSAGADSYEDSSRHHHHHAAVSKATATSGYTGNSASTKRCRRKKTFAELKEEESSLLKESIYLKKEIASVNANFEAQRAKNESLKRMKLDVGSKYQNNPSSTSVEPQRLPAGQPHQRIVVSTEALIRPIQEDTHSLASESRPNRIKSTGESFFLIPDLNMVPSEDVSCTDALCGMS

SEQ ID NO: 296 - protein, 204 aa, Arabidopsis thaliana
  misc_feature: Public GI ID NO.42573123
  misc_feature (1)..(204): Functional Homolog of  Ceres CLONE NO.13660 at SEQ ID NO.285 with e-value of 2.19E-14 and BLAST sequence identity of 52.0
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKVDFRCYSLFYYHGFHCILKKTQYFSTGDCKSPSNIR

SEQ ID NO: 297 - protein, 253 aa, Arabidopsis thaliana
  misc_feature: Public GI ID NO.21593304
  misc_feature (1)..(253): Functional Homolog of  Ceres CLONE NO.13660 at SEQ ID NO.285
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKEIASLRATFDEQNLRNQKLKRIKLDLNSGRVTNKKPVDLIRKSQLERLQGSKSCKTSDSQNQGSFFVLPDLNMAPSEEEILYGTS

SEQ ID NO: 298 - DNA, 1535 bp, Glycine max
  misc_feature: Ceres CLONE ID no.708396
  misc_feature: Encodes the peptide sequence at SEQ ID NO 299
attcacttctgatttgattcttttccccactttcagaacatcaacaaagtagagagagagaaccaaaaaaaaaaaactactactcaacaaaaagagctagagagaagataccccttaaatcctaatttctacctcaaagaaagtactcttcaaacattttgtattcactgaagaaggatctttgcacttgcacctgcagccatctaccatggttaagtcagaacacaagatcaaaaccgaaccatcatcaaaggcaatgcggttatcttcaccctcatcatcaacatcagattgcaagaagaagaagtacaagggagtgagaatgaggagctggggatcatgggtttctgagattagagcaccaaatcagaaaacaagaatatggttaggctcttattcaaccccagaagctgcagctagagcctatgatgctgcacttctatgccttaaaggctcctcagcaaatctcaatttccctttaagctcttcacaacaatacattcctggagatgctgtcatgtcccccaaatcaatccaaagagttgctgcggccgccgcaaatagtttcatcgacaatgccaccactcccccttccccacctccggcttcgaccccatcatcatcatcattggcctcatccccctcattggtttcttctccctcggatcaaatcgatgacgacgccttgctgatatcgtctttccaagcctacactagttgtggtcaagcaaatcaatcaatggctgtgaatgtgatggagccttggtacacctttggtgatggtcttcaatcccccaagtatgctgatcagatgctaagtggtgatttcttccatgtcgattcttcccatctgcttgatgatctatacgaagaaagtgacattcgtttgtggagcttctgctgagaaaaaaaatcaattcaagccacctacaatatttcttcttttctcaaaaattcaattcgtttgtcttcagtggtatagcttaagatgttactgactgtgaccaaattaaaatttgtataccctatgctacataaatggtgcattttagatgaaattcatatagagataagacaattttcggcctctcatgtgaatttctaagagtttgaaattatgtatcatcgatacaaatcttggtatgtcaatgtcatgaatggtttcccatgtgtcacagaatataagggagaaaaaaaaatgtagtcaccaaaatccttaggtataagcaattcgtttcactgtttttggaatgtaactatgggaggagacttttgctattgtgagtatctttggaaggcctttgttgcatgggaaggtatcagagatgcttatttccaattcagtgagaatagggaaccatgtacagagcgtggtaacttgaaaccattggaaaaattgcatcttttctaagccttgtctgctctcccgcgtgcccaaagaacaaagagtgttcccttgttttgatgtttaagtttggtattttataccctattctattcttcttttagatggaaataaatcctggttaattttc

SEQ ID NO: 299 - protein, 231 aa, Glycine max
  misc_feature: Ceres CLONE ID NO.708396
  misc_feature (32)..(95): Pfam Name: AP2 Pfam Description: AP2 domain
MVKSEHKIKTEPSSKAMRLSSPSSSTSDCKKKKYKGVRMRSWGSWVSEIRAPNQKTRIWLGSYSTPEAAARAYDAALLCLKGSSANLNFPLSSSQQYIPGDAVMSPKSIQRVAAAAANSFIDNATTPPSPPPASTPSSSSLASSPSLVSSPSDQIDDDALLISSFQAYTSCGQANQSMAVNVMEPWYTFGDGLQSPKYADQMLSGDFFHVDSSHLLDDLYEESDIRLWSFC

SEQ ID NO: 300 - DNA, 648 bp, Populus balsamifera subsp. trichocarpa
  misc_feature: Ceres ANNOT ID no.1443312
  misc_feature: Encodes the peptide sequence at SEQ ID NO 301
atggtgaagaacgagcacaagatccagtcagagacttcaacgccaatgccaacatcttcatcagcatgcaagaagaagaaatacaagggagttagaatgagaagttggggctcatgggtttctgagataagggcaccaaatcaaaaaacaagaatatggttaggctcttattcaactcctgaagctgctgctagagcctatgatgctgcacttttatgtcttaagggctcttcagccaatctcaactttcctattacttcctcgcattacattcctgacgctgtgatgtcccccaagtccattcagagagtggctgcagctgctgctaatagctctgaagacaatcccaccacccctcaagtatcctcacttcctcttccttcctcctcctcctcgtcatcatcatcaatcctatcatccccgtcaatggtttcctcaccgtccgatcagccagatgattatatgtcactaatggaatcgtttgagaccgacaatgaaccaattccaatgctagattcttggtacaattttgatggattacaatcaccaaagtatattgatcaaatgttcaatggggtctcattcaatccaccgatgatcgatgatttctacgaaggcgatattcgtctatggagctttgctgaatag

SEQ ID NO: 301 - protein, 215 aa, Populus balsamifera subsp. trichocarpa
  misc_feature: Ceres ANNOT ID NO.1443312
  misc_feature (1)..(215): Functional Homolog of  Ceres CLONE NO.708396 at SEQ ID NO.299 with e-value of 4.30E-66 and BLAST sequence identity of 73.2
MVKNEHKIQSETSTPMPTSSSACKKKKYKGVRMRSWGSWVSEIRAPNQKTRIWLGSYSTPEAAARAYDAALLCLKGSSANLNFPITSSHYIPDAVMSPKSIQRVAAAAANSSEDNPTTPQVSSLPLPSSSSSSSSSILSSPSMVSSPSDQPDDYMSLMESFETDNEPIPMLDSWYNFDGLQSPKYIDQMFNGVSFNPPMIDDFYEGDIRLWSFAE

SEQ ID NO: 302 - DNA, 720 bp, Populus balsamifera subsp. trichocarpa
  misc_feature: Ceres ANNOT ID no.1452068
  misc_feature: Encodes the peptide sequence at SEQ ID NO 303
atggctggacagacagagagcatttggtttttgaaggttgcaaaatctatattgctccatctaacaatggtgaagagcgagcacagaatccagtcagaggcttcaaaaccagtggccatatcatcaacgccttcaccgtcagcatgcaagaagaggaaatacaagggagttagaatgagaagttggggctcatgggtgtcagagataagggcaccgaatcagaaaacaagaatatggttaggctcttattcaactcctgaagctgctgctagagcctatgatgctgcacttttttgtctcaagggctccgcagccgctctcaactttcctattacttcctcgcattacattcctgacactgttatgtccccgaagtccattcaaagagtggctgcagctgccgctaatagttttgtagacaatcccaccaccccacagtcatcatcacctcctctcccttgttcctcctcctcctcctcgtcaatctcatcacccccatcagtggtttcctcgccgtccgatattcagcttgatgattatatatcactgatggaatcttttgagaccaacaatgaaccagtttcaatgctagattcttggtacaattttgatgtcttacaatcaccgaagtatcttgatctcaattgggtctcattcaatccaccaatgatcgatgatttatacgaaggggatcttcgtctatggagctttgctgaatag

SEQ ID NO: 303 - protein, 239 aa, Populus balsamifera subsp. trichocarpa
  misc_feature: Ceres ANNOT ID NO.1452068
  misc_feature (1)..(239): Functional Homolog of  Ceres CLONE NO.708396 at SEQ ID NO.299 with e-value of 2.09E-64 and BLAST sequence identity of 72.0
MAGQTESIWFLKVAKSILLHLTMVKSEHRIQSEASKPVAISSTPSPSACKKRKYKGVRMRSWGSWVSEIRAPNQKTRIWLGSYSTPEAAARAYDAALFCLKGSAAALNFPITSSHYIPDTVMSPKSIQRVAAAAANSFVDNPTTPQSSSPPLPCSSSSSSSISSPPSVVSSPSDIQLDDYISLMESFETNNEPVSMLDSWYNFDVLQSPKYLDLNWVSFNPPMIDDLYEGDLRLWSFAE

SEQ ID NO: 304 - DNA, 654 bp, Populus balsamifera subsp. trichocarpa
  misc_feature: Ceres ANNOT ID no.1505156
  misc_feature: Encodes the peptide sequence at SEQ ID NO 305
atggtgaagagcgagcacagaatccagtcagaggcttcaaaaccagtggccatatcatcaacgccttcaccgtcagcatgcaagaagaggaaatacaagggagttagaatgagaagttggggctcatgggtgtcagagataagggcaccgaatcagaaaacaagaatatggttaggctcttattcaactcctgaagctgctgctagagcctatgatgctgcacttttttgtctcaagggctccgcagccgctctcaactttcctattacttcctcgcattacattcctgacactgttatgtccccgaagtccattcaaagagtggctgcagctgccgctaatagttttgtagacaatcccaccaccccacagtcatcatcacctcctctcccttgttcctcctcctcctcctcgtcaatctcatcacccccatcagtggtttcctcgccgtccgatattcagcttgatgattatatatcactgatggaatcttttgagaccaacaatgaaccagtttcaatgctagattcttggtacaattttgatgtcttacaatcaccgaagtatcttgatctcaattgggtctcattcaatccaccaatgatcgatgatttatacgaaggggatcttcgtctatggagctttgctgaatag

SEQ ID NO: 305 - protein, 217 aa, Populus balsamifera subsp. trichocarpa
  misc_feature: Ceres ANNOT ID NO.1505156
  misc_feature (30)..(93): Pfam Name: AP2 Pfam Description: AP2 domain
  misc_feature (1)..(217): Functional Homolog of  Ceres CLONE NO.708396 at SEQ ID NO.299 with e-value of 2.09E-64 and BLAST sequence identity of 72.0
MVKSEHRIQSEASKPVAISSTPSPSACKKRKYKGVRMRSWGSWVSEIRAPNQKTRIWLGSYSTPEAAARAYDAALFCLKGSAAALNFPITSSHYIPDTVMSPKSIQRVAAAAANSFVDNPTTPQSSSPPLPCSSSSSSSISSPPSVVSSPSDIQLDDYISLMESFETNNEPVSMLDSWYNFDVLQSPKYLDLNWVSFNPPMIDDLYEGDLRLWSFAE

SEQ ID NO: 306 - DNA, 1160 bp, Arabidopsis thaliana
  misc_feature: Ceres CLONE ID no.19721
  misc_feature: Encodes the peptide sequence at SEQ ID NO 307
atctctatccatccacaacaacaacaaaaactcaagaacaatatctccacttgatcactaccacattgtccaatcactctacaaagcctgtacgtacacaacaacattaccatggtgaaacaagaacgcaagatccaaaccagcagcacaaaaaaggaaatgcctttgtcatcatcaccatcttcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctgccaactcatttaaccattttgcccctacttcatcagccgtctcgtcaccgtccgatcatgatcatcaccatgatgatgggatgcaatctttgatgggatcttttgtggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagttttctaaatcattttttaaattcttttttatatatgtaacatatatttaccctcgtcgtaattattcatttccaagttgtttgttgcttggagagaattgacgacggatacgattatataatataattgtaagtttttatatgtagcaaactcggtacaattcggatttaatagggatctaggaagttcacatgaacaagcgactcttttttttgtcacttctttgactttttcatgtgaggtttcttttcatcaattttttttaacaatgtgtgaaaatatttctgtattgtaatgatatatttcgcacaatagttttgc

SEQ ID NO: 307 - protein, 231 aa, Arabidopsis thaliana
  misc_feature: Ceres CLONE ID NO.19721
  misc_feature (49)..(112): Pfam Name: AP2 Pfam Description: AP2 domain
  misc_feature (1)..(231): Functional Homolog of  Ceres CLONE NO.708396 at SEQ ID NO.299
MVKQERKIQTSSTKKEMPLSSSPSSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 308 - DNA, 1299 bp, Zea mays
  misc_feature: Ceres CLONE ID no.325346
  misc_feature: Encodes the peptide sequence at SEQ ID NO 309
acacaagcagcaacatcactgatcgccgtgcagcctggtacgtaccacacacacacacacacatacagaagaagaacgtaccttgcgctacaaccccgtcgccgccgactacgccgatcgtgtccacgggaaccaagcaaagcaaagcaagcgacgcatcggaagaagccggagaccgaccgaccgaccgagctacctagctacagctcatcagcccatggtgaagacggcgacggcgacggcggcggcgaggcacggcggcgctcataagaggacgtacaagggcgtgcggatgcggagctggggctcctgggtgtcggaggtgcgggcgccgggccagaagacgaggatmtggytsggctcccactccaccgccgaggccgcggcgcgcgchtacgacgccgcgctgctctgcctcaggggctcggcggccgcgccggacctcaacttcccgccccgccgcccgctcgccgacggcctccacccgctgccccccgccgccatgtcgcccaaggccatccagcgcgtggccgccgccgccgcggcctgctgcgctcctcagagtaacggcattggcagtgcctgctgcgccgcgccctgcgctcctccgagtaatggcattggcagcgcctgcggccacgccgagaccgccccggcgttgagcggcagcccgccctccagcgacagcgacgtctcctccccggaggcggggtccaccgccagcagcgacggcgagctggcccgctacggcgacggcgacggcgacggcggcgtcagcgtggactacggctcgctcgccgacatcgacgccttcttccagtcgcccaagtgcatggacgacgaccactactactmcgcagcgctcatggacccctgcggcgccttcttcgcgccggcgccatcggttgcggcggacgacgacgcagcagccgccgccggatgctgggaggacggcgacggcattgcgctctggagcttcagcttccccgctctggactgctgagctgaagcggcgcagattccgctactactgacgattgacgactaatcgccggtcaagcgatggaaaccgctttatttgcttcatcgacggcacaggtttccgcatacatgataaatttacccaatttaattcgatgtatgtaaacattcttaataagctgattgttaagcgttgtagtggtggggagctctcatggctgaagctgcatgttttaaggtagctttttccatggagttaacctctttgctattgcttgtctatgagtaaacaaaaaaaaaaacagttttattgccagc

SEQ ID NO: 309 - protein, 261 aa, Zea mays
  misc_feature: Ceres CLONE ID NO.325346
  misc_feature (19)..(84): Pfam Name: AP2 Pfam Description: AP2 domain
  misc_feature (1)..(261): Functional Homolog of  Ceres CLONE NO.708396 at SEQ ID NO.299 with e-value of 7.00E-27 and BLAST sequence identity of 60.3
  misc_feature (45)..(45): Xaa is any aa, unknown, or other
  misc_feature (47)..(47): Xaa is any aa, unknown, or other
  misc_feature (59)..(59): Xaa is any aa, unknown, or other
  misc_feature (213)..(213): Xaa is any aa, unknown, or other
MVKTATATAAARHGGAHKRTYKGVRMRSWGSWVSEVRAPGQKTRXWXGSHSTAEAAARXYDAALLCLRGSAAAPDLNFPPRRPLADGLHPLPPAAMSPKAIQRVAAAAAACCAPQSNGIGSACCAAPCAPPSNGIGSACGHAETAPALSGSPPSSDSDVSSPEAGSTASSDGELARYGDGDGDGGVSVDYGSLADIDAFFQSPKCMDDDHYYXAALMDPCGAFFAPAPSVAADDDAAAAAGCWEDGDGIALWSFSFPALDC

SEQ ID NO: 310 - DNA, 1182 bp, Triticum aestivum
  misc_feature: Ceres CLONE ID no.617383
  misc_feature: Encodes the peptide sequence at SEQ ID NO 311
agaccagtgagcgcagcacacagatcagcactcaacaacaagccttgcgttgcaaaccatcgaccgaaggaaccgactgagctaagaggaggttcgccgagaagctagccgtgcgtagcaatggtgaagactgcggcagctgggagcactggcgatggcgccgtggcagcgaagcagcagcagcttggcggcaagatgaggacgtacaagggcgtgcggatgaggagctggggcgcgtgggtgtcggagatccgggcgcccgggcagaagacgcggatatggctcggctcccactccaccgccgaggccgccgcgcgcgcctacgacgccgcgctgctctgcctcaagggcgcctccgccgccgccgacctcaacttccccgtgcgcttccccttcgacctccccgccgccgccatgtcgcccaagtccatccagcgcgtcgccgcagccgccgccgccggggccagcgctaatgtgttcgacttcgccgctgccgacgacagtgccagcgctaatgccgtcgacttcgccggtgccgacgacagcgccagcgcggtcacccccgagtactgcagctcctccagcaatgcctcgccggtgagctctccggagacggcaagcagtggcggcgccgacctcgacggcgtagacctcctgggttacggttacagccagtgctcgctcgcggaaatcgaggccttcttccagtcgcccaagtgcatggagtacgccatgatggacccgtgcagcaccttcttcgctccggcgccgatagcaatggaggacgagtgcagctgggaggaaggaggcgacattgcgctctggagctactgaaccggagtccgggaagccggagaaccgaagaaactgacaaatcgttactcaagcgaaggccagaactggccatgcatggtgataactatccttaatttcatatatgtggtaaattaattcgattcattgtacacaacaacaataaggtagttgagcgttgtgggggggagctctcatggagctacatgttttaaggcagcttccatggagttaacctcccttcaattgcttgttacatccgtgttaaaaaagctgctttgcaattgcaagcatatatttcctttgaaaaaaaaaaaaaaaaaaaaaaaaaaaaaaaaaaaaaaaaaaaaaaaaaaaaaaaaaaaaaaa

SEQ ID NO: 311 - protein, 237 aa, Triticum aestivum
  misc_feature: Ceres CLONE ID NO.617383
  misc_feature (27)..(92): Pfam Name: AP2 Pfam Description: AP2 domain
  misc_feature (1)..(237): Functional Homolog of  Ceres CLONE NO.708396 at SEQ ID NO.299 with e-value of 1.39E-28 and BLAST sequence identity of 56.7
MVKTAAAGSTGDGAVAAKQQQLGGKMRTYKGVRMRSWGAWVSEIRAPGQKTRIWLGSHSTAEAAARAYDAALLCLKGASAAADLNFPVRFPFDLPAAAMSPKSIQRVAAAAAAGASANVFDFAAADDSASANAVDFAGADDSASAVTPEYCSSSSNASPVSSPETASSGGADLDGVDLLGYGYSQCSLAEIEAFFQSPKCMEYAMMDPCSTFFAPAPIAMEDECSWEEGGDIALWSY

SEQ ID NO: 312 - DNA, 1299 bp, Triticum aestivum
  misc_feature: Ceres CLONE ID no.910527
  misc_feature: Encodes the peptide sequence at SEQ ID NO 313
gcaccagccacacacccaaccaaccacccctagctaccacttcaacctgcactggtctctgcacactctcggagttcagcgtcgctcgcagatcaaagaagtcaagttcgtgtcacagcgaggagcgtcgtcggtgagcgtgatcggtcgggaaatggtgaagagcgcgcagcagcagccgcagggggggctcggcggcgacggcggcaatgcggtggcggcgaggcagggcggcggcggcggcgggaggcagcagcagcagcagtacaagggcatgcggatgcggagctgggggtcgtgggtgtcggagatccgggcgcccaaccagaagacgcgcatatggctcggctcctactccaccgccgaggccgccgcgcgcgcctacgacgccgcgctgctctgcctccggggctccgccgccgacctcaacttccccgtgcacctccccttccacgtccccgccggcgccatgtcgcccaagtccatccagcgcgtcgccgctgccgccgccgccagtgccagcagcagccccctgcagcctccccacaccatggcctcctctgcctcctggcccggcgccgccccgccgtgcggctacggcgacaacgcgtcgtccttcggctccccagaggaccggtccgcccgccacagcaacgccgacgacgacgagaccatggcgcacggcgacgacggcgtggactacgacgcgctggcggacatcgacgccttcttccagtcgcccaagtgcatggactacgccatgatgatggacccgtgcagcaccttcttcgcgccggcgcccatggcgcccgtcgagtgggaggaggaaggcgagatcagcctctggagcttctcctcctacaactgatcgagctcaaatgccagctccgaccgagagcttcgagcttcgagcttcgactggccatggaggccatttcatgcttcgactggtcaaatcaccactaagcaattccatcaacactgacagattaattactcaactaccactacgagtgaccaagaattggtcacggtaaaaataatcgcaggccatgatcaattcttacttcatggcctcgcgaagaatgatgattaattattatttcattcatattccgtagctaaatataatatactagtaccactggcgtactagtagtacgtatccgtacaaggccaattatgcatttgtgggggaggtctgatggagctacatgttttaaggcagcttccatggagccaactcccttcaattagtttacatgtgtactagtatgtgtaagaaaaaaaaaaaaaaaa

SEQ ID NO: 313 - protein, 237 aa, Triticum aestivum
  misc_feature: Ceres CLONE ID NO.910527
  misc_feature (36)..(99): Pfam Name: AP2 Pfam Description: AP2 domain
  misc_feature (1)..(237): Functional Homolog of  Ceres CLONE NO.708396 at SEQ ID NO.299 with e-value of 1.29E-32 and BLAST sequence identity of 49.4
MVKSAQQQPQGGLGGDGGNAVAARQGGGGGGRQQQQQYKGMRMRSWGSWVSEIRAPNQKTRIWLGSYSTAEAAARAYDAALLCLRGSAADLNFPVHLPFHVPAGAMSPKSIQRVAAAAAASASSSPLQPPHTMASSASWPGAAPPCGYGDNASSFGSPEDRSARHSNADDDETMAHGDDGVDYDALADIDAFFQSPKCMDYAMMMDPCSTFFAPAPMAPVEWEEEGEISLWSFSSYN

SEQ ID NO: 314 - DNA, 1014 bp, Triticum aestivum
  misc_feature: Ceres CLONE ID no.1048424
  misc_feature: Encodes the peptide sequence at SEQ ID NO 315
gtgtggtgtggcagcaagatctcatctccgcagcagggagctatagcgcgtggaaaatggtcaagaaccacccgggcagcggcactagcaggtgcgacgctgcggcggctatggcagagagcggtggtgggggtgggacggcagcgctgtgcggcggcgggagtaggcagccggcgatggcggcgaggcagttcaagggggtgcggatgcggagctgggggtcgtgggtgtcggagatcagggcgccgcaccagaagcgccggatctggctcggctcctacgccaccccggaggccgccgcgcgcgcctacgacgccgcgctcctctgcctcaagggctccgacgccgtcctcaacttcccctcgtcgtcctccgcctcaccctcgtcgccgcattcgcttccctcccccgccaatcgacacgccgacgacctgtccccgaggtccatccagcgcgcggccgccgctgcggcagcggccttcgaggccaccaggatcgtcgtggacgacagctgctcttccagcgcggaggcgacgacgccgacctcgttctcagtgtccacgctggggagcgccgacgtccaggagcacgccacgtcttcgatgtccgccgcggccagcactggctcgccggtgggagatcaggacgagctgtggacggagctggacgcgttcgcgtcccccaagctcatggacctcatcgccgccggtcacgccacgcccttctcttgcacctgggaggagcccgaggaggacggcgacatgatgaggctctggagcttctgctagagtgaagcgtccatcgtctgcagtgggtcgacattgatatgcgcatccatgagtcgatcgccattgatcattggttttttctatctcccatggaggctagctaggtgcatgcatggatcctctctactaggctctagctaggtctcactccaagtctgcttccatagattctttctttcatttagtaagaacataatacttatacaatataaaaaaaaaaaaaaaa

SEQ ID NO: 315 - protein, 243 aa, Triticum aestivum
  misc_feature: Ceres CLONE ID NO.1048424
  misc_feature (44)..(107): Pfam Name: AP2 Pfam Description: AP2 domain
  misc_feature (1)..(243): Functional Homolog of  Ceres CLONE NO.708396 at SEQ ID NO.299 with e-value of 3.50E-32 and BLAST sequence identity of 52.1
MVKNHPGSGTSRCDAAAAMAESGGGGGTAALCGGGSRQPAMAARQFKGVRMRSWGSWVSEIRAPHQKRRIWLGSYATPEAAARAYDAALLCLKGSDAVLNFPSSSSASPSSPHSLPSPANRHADDLSPRSIQRAAAAAAAAFEATRIVVDDSCSSSAEATTPTSFSVSTLGSADVQEHATSSMSAAASTGSPVGDQDELWTELDAFASPKLMDLIAAGHATPFSCTWEEPEEDGDMMRLWSFC

SEQ ID NO: 316 - protein, 238 aa, Oryza sativa
  misc_feature: Public GI ID NO.50913131
  misc_feature (32)..(95): Pfam Name: AP2 Pfam Description: AP2 domain
  misc_feature (1)..(238): Functional Homolog of  Ceres CLONE NO.708396 at SEQ ID NO.299
MVKSGQEAAPGSGGNAAAAAARQGGGGGGRGRQYKGVRMRSWGSWVSEIRAPNQKTRIWLGSYSTAEAAARAYDAALLCLKGSAADLNFPVHLPFHIPAAAMSPKSIQRVAAAAAANATSPLQHHSGAPSFATATGGYNPAAAPTTPPCSYGDMSSCSAVSSPETANYYGADHDMVAREDDVDYAALADIDAFFQSPKCMDYSMMDPCSTFFSPAPESLAAEWEDEGEISLWSFSSLN

SEQ ID NO: 317 - protein, 230 aa, Arabidopsis thaliana
  misc_feature: Public GI ID NO.6552733
  misc_feature (48)..(111): Pfam Name: AP2 Pfam Description: AP2 domain
  misc_feature (1)..(230): Functional Homolog of  Ceres CLONE NO.708396 at SEQ ID NO.299
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 318 - protein, 231 aa, Arabidopsis thaliana; identical to SEQ ID NO: 307
  misc_feature: Public GI ID NO.21554056
  misc_feature (49)..(112): Pfam Name: AP2 Pfam Description: AP2 domain
  misc_feature (1)..(231): Functional Homolog of  Ceres CLONE NO.708396 at SEQ ID NO.299 with e-value of 5.80E-39 and BLAST sequence identity of 59.2

SEQ ID NO: 319 - DNA, 976 bp, Arabidopsis thaliana
  misc_feature: Ceres CLONE ID no.231890
  misc_feature: Encodes the peptide sequence at SEQ ID NO 320
agaatacttttatctcatattcccaacacttgttcaagcatatctaagtcaataacaacattacaacataacatggtgaaacaagaactcaagatccaagttactacttcctcatcatcactctctcattcttcatcttcttcttcttcttcaacgtcggcactacgtcatcaatcttgtaagaacaagataaagaagtataaaggtgtgaggatgcgaagttggggatcatgggttactgaaattagggcaccaaatcaaaagacaagaatctggttaggttcttactccaccgcagaagcagctgctagggcttacgacgctgctctcttgtgtcttaagggacctaaagctaatctcaacttccctaacatcaccactacttctccttttcttatgaacatcgacgaaaagacccttttgtccccaaaatcaatccaaaaggtcgccgctcaagccgctaactcctcttctgaccattttacccctccgtccgatgaaaatgatcatgatcatgaagacggactcgatcaccatccatctgcttcttcttcagctgcatcttcaccaccagatgatgatcatcataatggatgacgatgggtgatttggtatcgktgatggaatctttcgkgggattaccaacgaacaccgtgkctytggatgggatccatcgctgkatggaaatttggacataatgagatcttcttcaccaacggagatccgtttgattattctccacagttacatagctcaaaggcaacgatggatgacttctacgacgatgttgatattccgctgtggagtttcagttaatccaacggtccatattattatactacgaaacacttttaattcacattatttcatttaatttattctttcaattcatattattcgtccttgttgtttcgttatgtattaaatatacacacactaatttaagaagatcacatggactagaggtttttttgtc

SEQ ID NO: 320 - protein, 79 aa, Arabidopsis thaliana
  misc_feature: Ceres CLONE ID NO.231890
  misc_feature (41)..(104): Pfam Name: AP2 Pfam Description: AP2 domain
  misc_feature (1)..(79): Functional Homolog of  Ceres CLONE NO.708396 at SEQ ID NO.299 with e-value of 2.10E-18 and BLAST sequence identity of 75.3
  misc_feature (1)..(79): Functional Homolog of  Ceres CLONE NO.231890 at SEQ ID NO.319 with e-value of 1.60E-41 and BLAST sequence identity of 53.3
  misc_feature (1)..(79): Functional Homolog of  Ceres CLONE NO.100156 at SEQ ID NO.322 with e-value of 8.60E-24 and BLAST sequence identity of 78.2
  misc_feature (79)..(79): Xaa is any aa, unknown, or other
MVKQELKIQVTTSSSSLSHSSSSSSSSTSALRHQSCKNKIKKYKGVRMRSWGSWVTEIRAPNQKTRIWLGSYSTAEAAX

SEQ ID NO: 321 - DNA, 987 bp, Arabidopsis thaliana
  misc_feature: Ceres CLONE ID no.100156
  misc_feature: Ceres LOCUS ID At1g21910
  misc_feature: Encodes the peptide sequence at SEQ ID NO 322
atcaaaaaatctctatccatccacaacaacaacaaaaactcaagaacaatatctccacttgatcactaccacattgtccaatcactctacaaagcctgtacgtacacaacaacattaccatggtgaaacaagaacgcaagatccaaaccagcagcacaaaaaaggaaatgcctttgtcatcatcaccatcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctkccaactcatttaaccatttttgcccctacttcatcaggccgtctcgtcaccgtcccgatcatgatcatcaccatgatgatgggatgcaatctttgrtgggatctttttggkggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagttttctaaatcattttttaaattcttttttatatatgtaacatatatttaccctcgtcgtaattattcatttccaagttgtttgttgcttggagagaattgacgacggatacgattatataatataattgtaagttttt

SEQ ID NO: 322 - protein, 230 aa, Arabidopsis thaliana; identical to SEQ ID NO: 317
  misc_feature: Ceres CLONE ID NO.100156
  misc_feature: Ceres LOCUS ID At1g21910
  misc_feature (48)..(111): Pfam Name: AP2 Pfam Description: AP2 domain
  misc_feature (1)..(230): Functional Homolog of  Ceres CLONE NO.708396 at SEQ ID NO.299 with e-value of 3.60E-39 and BLAST sequence identity of 59.2
  misc_feature (1)..(230): Functional Homolog of  Ceres CLONE NO.231890 at SEQ ID NO.319 with e-value of 1.60E-41 and BLAST sequence identity of 53.3
  misc_feature (1)..(230): Functional Homolog of  Ceres CLONE NO.100156 at SEQ ID NO.322 with e-value of 8.60E-24 and BLAST sequence identity of 78.2

SEQ ID NO: 323 - DNA, 1031 bp, Zea mays
  misc_feature: Ceres CLONE ID no.285154
  misc_feature: Encodes the peptide sequence at SEQ ID NO 324
aggtctctagtctccactccgctgtcgctccggcccagcagctcgaccaccaccgctccgcaggcaggaagccgccaaggacatggacgacgctcaggagcctccctcccctccctccccctcgcagtcatcctcctcctcttcctcgtcgtcctccgtggccccgaacccgaagaagcgggcgcgcaaggacggcagccggcacccgacgtaccgcggcgtgcgcatgcggagctggggcaagtgggtgtcggagatcagggagccccgcaagaagtctcgcatctggctgggcaccttcgccaccgcggagatggcggcgcgcgcgcacgacgtggccgcgctcgccatcaagggcgcgcgcgacgcgcacctcaacttcccgggcctcgcgcacctgctcccgcgcccggccaccgcggcgcccaaggacgtgcaggccgcggccgcgctcgccgcggccgccgacttccctctgccgccgtcccccggcggcgccaatgccaagagccccgagagcagcagctccggctccgcctccgcctccgcctcctgacgacgccagcgccgcctcgccggcggcgccgcaggacgccgagcccaacccggacgacgcgctgttcgacctcccggacctgcttctggacctgagatgctgcgggccgtcgtcgtgggccgtcgacgacgacgtggccggcggcggcgcgttccggatcatcgaggagccgctgctgtgggagtactgaactgatcaatgccaccgcgccagtcctgtccttgagcggttggcagtgatcagcgagttcatgcatcggtagctgttgagtgttagatcgaccggacggacacatgtaaatgcagctccttccgctcctctgtttcgtgctctggattactctgctgtttcttctctttatgccagatttaggtgccgcgcttgtataaagttagttcctttttttccctccttctcttgcttgatttggaagacaagaatatgtataaccataagaagcatcttatcttgtgcc

SEQ ID NO: 324 - protein, 220 aa, Zea mays
  misc_feature: Ceres CLONE ID NO.285154
  misc_feature (42)..(106): Pfam Name: AP2 Pfam Description: AP2 domain
  misc_feature (1)..(220): Functional Homolog of  Ceres CLONE NO.708396 at SEQ ID NO.299
  misc_feature (1)..(220): Functional Homolog of  Ceres CLONE NO.231890 at SEQ ID NO.319 with e-value of 1.60E-41 and BLAST sequence identity of 53.3
  misc_feature (1)..(220): Functional Homolog of  Ceres CLONE NO.100156 at SEQ ID NO.322 with e-value of 8.60E-24 and BLAST sequence identity of 78.2
MDDAQEPPSPPSPSQSSSSSSSSSSVAPNPKKRARKDGSRHPTYRGVRMRSWGKWVSEIREPRKKSRIWLGTFATAEMAARAHDVAALAIKGARDAHLNFPGLAHLLPRPATAAPKDVQAAAALAAAADFPLPPSPGGANAKSPESSSSGSASASASDDASAASPAAPQDAEPNPDDALFDLPDLLLDLRCCGPSSWAVDDDVAGGGAFRIIEEPLLWEY

SEQ ID NO: 325 - protein, 238 aa, Oryza sativa subsp. japonica; identical to SEQ ID NO: 316
  misc_feature: Public GI ID NO.46805442
  misc_feature (1)..(238): Functional Homolog of  Ceres CLONE NO.708396 at SEQ ID NO.299 with e-value of 4.30E-34 and BLAST sequence identity of 47.7
  misc_feature (1)..(238): Functional Homolog of  Ceres CLONE NO.231890 at SEQ ID NO.319 with e-value of 1.60E-41 and BLAST sequence identity of 53.3
  misc_feature (1)..(238): Functional Homolog of  Ceres CLONE NO.100156 at SEQ ID NO.322 with e-value of 8.60E-24 and BLAST sequence identity of 78.2

SEQ ID NO: 326 - DNA, 783 bp, Arabidopsis thaliana
  misc_feature: Ceres ANNOT ID no.543998
  misc_feature: Ceres LOCUS ID At1g21340
  misc_feature: Encodes the peptide sequence at SEQ ID NO 327
atgttgccgtacattggacacaacagctaccagcagcaccagtttccgttgccggagatggaaattccggagaagtggaagctttcttacgaacaagaggctattactgctccggcttgtcctcgttgtgcatcgtccaacaccaagttttgttattacaacaactacagcttgtctcagcctagatacttctgcaagggttgccgtcgttactggacgaaaggcggttctctccgcaacattcctgtaggtggaggctgtcgcaagagaagtcgaagcagacagaacagtcacaaaaggtttggccggaacgagaatcggccagatggtcttattaaccaagatgatggattccagtccagccctcctggttctgatattgatttggctgcggttttcgcacaatatgtgactgatcggagcccttctagtacagataatactactggatccgatcaagattcaccgataacaacaaccactcatgctttagaatctttgagttgggatatctgccaagaaactgatgtggatcttggattctacggggaattcaataatctaactcagaagaccaaagaggatcaagaagtatttggtcagtttctccaagaagatcgagaggagatcttcgagttccagggtttactcgatgacaaagagattcaagagatcctggaatgctcattctcagaggagccagaccagttagtttctcaggggagcttcatgatcaatggtgataactggagttcaacagatcttaccaggttcgggatttga

SEQ ID NO: 327 - protein, 260 aa, Arabidopsis thaliana
  misc_feature: Ceres ANNOT ID NO.543998
  misc_feature: Ceres LOCUS ID At1g21340
  misc_feature (33)..(95): Pfam Name: zf-Dof Pfam Description: Dof domain, zinc finger
  misc_feature (1)..(260): Functional Homolog of  Ceres ANNOT NO.543998 at SEQ ID NO.327
MLPYIGHNSYQQHQFPLPEMEIPEKWKLSYEQEAITAPACPRCASSNTKFCYYNNYSLSQPRYFCKGCRRYWTKGGSLRNIPVGGGCRKRSRSRQNSHKRFGRNENRPDGLINQDDGFQSSPPGSDIDLAAVFAQYVTDRSPSSTDNTTGSDQDSPITTTTHALESLSWDICQETDVDLGFYGEFNNLTQKTKEDQEVFGQFLQEDREEIFEFQGLLDDKEIQEILECSFSEEPDQLVSQGSFMINGDNWSSTDLTRFGI

SEQ ID NO: 328 - DNA, 933 bp, Oryza sativa
  misc_feature: Ceres ANNOT ID no.1381104
  misc_feature: Encodes the peptide sequence at SEQ ID NO 329
atgatggcaggagctcccccgatgcatatctgcatggactccgactggctcaagggcatcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaataactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcatcatcttgcgccgccgccgccggcggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcgtcgcggagtaccatgcgctgagcgcgctccggttcgcggcagggctcggcgatcacctggcgctgccgttcggcgcggtgcgggcggagcacgacgccgtcgaggtgaagccggtggcggcggagaggctgctgtcgctcgagtggtgcggcgaggcgagccgcacggcggcgccggagagctccattagctcgctgggcgggctgggactgtggagcggcatgatcggcggcgggcaccatcaccatggctcctccgctgccatctga

SEQ ID NO: 329 - protein, 310 aa, Oryza sativa
  misc_feature: Ceres ANNOT ID NO.1381104
  misc_feature (1)..(310): Functional Homolog of  Ceres ANNOT NO.543998 at SEQ ID NO.327
MMAGAPPMHICMDSDWLKGIVPEEHGMGSSSPSAELIACPRAPMQAAAAAADRRLRPQHDQPLKCPRCESTHTKFCYYNNYSLSQPRYFCKTCRRYWTKGGSLRNVPVGGGCRKNKRAPPKKAAAHAQPAVAVAAALQGRHMETGLHLSFSGMQHHLAPPPPAAATAADPLCSLGLFDWKQYDPVFAGSGGGGSPVAALESAGGSEAQFMGAGMMGIGGGGVAEYHALSALRFAAGLGDHLALPFGAVRAEHDAVEVKPVAAERLLSLEWCGEASRTAAPESSISSLGGLGLWSGMIGGGHHHHGSSAAI

SEQ ID NO: 330 - DNA, 894 bp, Populus balsamifera subsp. trichocarpa
  misc_feature: Ceres ANNOT ID no.1467548
  misc_feature: Encodes the peptide sequence at SEQ ID NO 331
atggatactgctactcagtgggcacaggggattggtgctgttaatccaatggaaggttcaaggcctgatgtgttagagagaagggcaagggctcaaaaggatcaagctttgaattgtccaaggtgcaattccactaataccaaattttgttactacaacaactatagtctttctcagccaaggtacttttgcaagacttgtagaaggtattggactgcaggtgggtctttaagaaatgttccagttggtggtggttcaagaaagaacaagaggtcatcaagtactgcatcaacatcagcagcaggagcagctgcttcaaagaagtttcctcttgatctgacccagccaaatctcccccattcagcttctcaaaaccctaagatccatgaaggtcaagatctaaatctagcttaccccccatcagctgacgattatagtaatttgtctgagtttgttgagataccttttgatactgaaagcaacaaaacccaccatcaaaaccctaatccttcaagtacatctccctctcatcatcatcatcatcacgtctcacccatggagtttctcaagagtactgccatgaattcaagaggatttagtgctttcatgtcaattccaccactatccgattcaaacaacaccatgttttcaactgggtttcctttacaagaattcaagtcaactcagaatttttctttagaagggcttgaaagtgggtatagtaacactcaaggggtgcacgagacttgtggtagtgcaaggcttttgtttcctatagaagacttgaagcaacaagttccaagcaatactgaatttgaacagaataccagagagcaaagagataatgctccagttgggtattggaatggaatgttaggtggtggatcatggtaa

SEQ ID NO: 331 - protein, 297 aa, Populus balsamifera subsp. trichocarpa
  misc_feature: Ceres ANNOT ID NO.1467548
  misc_feature (32)..(94): Pfam Name: zf-Dof Pfam Description: Dof domain, zinc finger
  misc_feature (1)..(297): Functional Homolog of  Ceres ANNOT NO.543998 at SEQ ID NO.327 with e-value of 1.20E-22 and BLAST sequence identity of 85.1
MDTATQWAQGIGAVNPMEGSRPDVLERRARAQKDQALNCPRCNSTNTKFCYYNNYSLSQPRYFCKTCRRYWTAGGSLRNVPVGGGSRKNKRSSSTASTSAAGAAASKKFPLDLTQPNLPHSASQNPKIHEGQDLNLAYPPSADDYSNLSEFVEIPFDTESNKTHHQNPNPSSTSPSHHHHHHVSPMEFLKSTAMNSRGFSAFMSIPPLSDSNNTMFSTGFPLQEFKSTQNFSLEGLESGYSNTQGVHETCGSARLLFPIEDLKQQVPSNTEFEQNTREQRDNAPVGYWNGMLGGGSW

SEQ ID NO: 332 - DNA, 1482 bp, Zea mays
  misc_feature: Ceres CLONE ID no.445231
  misc_feature: Encodes the peptide sequence at SEQ ID NO 333
atctctccaccaaccggcggcaccaccagattcctctcttgctctgctctagcttcttctagctagccccctccttcgcaccacgcactattatctcatccgttcttccttcagtctatgtttatttgctctgcacatcatcgctcggtggccctgtcctcgctaccttccaattagtcggcaaggcaaaggcaccggcagagaggaagaaggccagttctatagtatatatgacgatcagggtaatgaattagctaccggctgcacagttttgtgggggtgtgtccgcgtggtgtgttgtgtgtgtctagctagctaggttttgcgtgtggctcgtcgatctgcttggcagaacagacctcgatcgtcgtcacgtttggccgacgtattctgatgatggccggggcaccgccgatgcacatctgcctggactcggactggctcaagggcatcgttcccgaggagcctgggatgggatcgtcgtcaccgtcagcggagctgatcgcgtgccctaggccaatgcacgccacggctgccgcggcggaccggcgtctgcgcccgcagcacgaccagccactcaagtgcccgcgatgcgagtccacgcacaccaagttctgctactacaacaactacagtctctcccagccgcgctacttctgcaagacgtgccgccgctactggaccaaaggcggatcgctccgcaacgtcccggttggtgggggatgccgcaagaacaagcgcgccagcgccaagaaaccccccgcgccaccgatgcagccgccgcacatgtcggagacgggcctccacctgtccttctccggcgtgcagcagctgccgccggccgatccgctttgcagcctcggccttttggactggaagtacgacccgatcctcacaggttccggtggcgtcgctggctcgttggatggcgccagctccgagacgcacttcgcagggacgggcatgctgggcatcccaggtgccagcgggggcggcgagtgccacgcgctgagcgcgctcaggtacgcggccggcctgggcgagaacctgcaggtgcagggtctcccgtttggggcgcgcgctgagcacgacgcgatggagatgaagcctgcggcgacggataggctgctctcgctggactggtacagcgagacaagccgcgcgccagagagcgccatcagctcgttgggcgcgctgggcctgtggagcggcatgctcggcggtgcgcaccagcaccatggctcgtcggcggccatctaagaccctagcaaaacgtgcctccatgcttgcgttgcattgcaccagtttgctaatggcgttaacaagtatgagtgactacgtagaaatgcttgtttttttacctgtttttatcttctgtttcgtttcgtcgtttgttttttggacgatccatgtttgccgctcgtcatttcagatgatgtctcttgttgtaccgcttcaaagttcaaacacttgctgtggttc

SEQ ID NO: 333 - protein, 288 aa, Zea mays
  misc_feature: Ceres CLONE ID NO.445231
  misc_feature (57)..(119): Pfam Name: zf-Dof Pfam Description: Dof domain, zinc finger
  misc_feature (1)..(288): Functional Homolog of  Ceres ANNOT NO.543998 at SEQ ID NO.327 with e-value of 1.29E-23 and BLAST sequence identity of 85.1
MMAGAPPMHICLDSDWLKGIVPEEPGMGSSSPSAELIACPRPMHATAAAADRRLRPQHDQPLKCPRCESTHTKFCYYNNYSLSQPRYFCKTCRRYWTKGGSLRNVPVGGGCRKNKRASAKKPPAPPMQPPHMSETGLHLSFSGVQQLPPADPLCSLGLLDWKYDPILTGSGGVAGSLDGASSETHFAGTGMLGIPGASGGGECHALSALRYAAGLGENLQVQGLPFGARAEHDAMEMKPAATDRLLSLDWYSETSRAPESAISSLGALGLWSGMLGGAHQHHGSSAAI

SEQ ID NO: 334 - protein, 299 aa, Oryza sativa subsp. japonica
  misc_feature: Public GI ID NO.19387252
  misc_feature (1)..(299): Functional Homolog of  Ceres ANNOT NO.543998 at SEQ ID NO.327 with e-value of 1.29E-23 and BLAST sequence identity of 85.1
MDSDWLKGIVPEEHGMGSSSPSAELIACPRAPMQAAAAAADRRLRPQHDQPLKCPRCESTHTKFCYYNNYSLSQPRYFCKTCRRYWTKGGSLRNVPVGGGCRKNKRAPPKKAAAHAQPAVAVAAALQGRHMETGLHLSFSGMQHHLAPPPPAAATAADPLCSLGLFDWKQYDPVFAGSGGGGSPVAALESAGGSEAQFMGAGMMGIGGGGVAEYHALSALRFAAGLGDHLALPFGAVRAEHDAVEVKPVAAERLLSLEWCGEASRTAAPESSISSLGGLGLWSGMIGGGHHHHGSSAAI

SEQ ID NO: 335 - DNA, 1700 bp, Triticum aestivum
  misc_feature: Ceres CLONE ID no.770468
  misc_feature: Encodes the peptide sequence at SEQ ID NO 336
catccggttggggctttggccatggctccgctgcttttcgctcccttcttattcacatctcccccctccacgtctctcaccaactaccagtagcaccgcagcccaccagcttcgctgcctcatatctcctcttccttctccatagcctctcttctcctgtccagtatctctgcgtcgatccaccccgccctcctcttcatcttcatgttcttcctagctaatcggtgaatccgcctcctcttagctaaccaatcgcccttaaacccgtcgacaaaataacgaaacgagaacaagcaggccgcgtgcgtgtgcagtaggtgtagaccatcgatcgtatctaggtttgagttgctgctggatcttggatttgccggagttacgtgcgtagctagccgctggcggtgaggttaccgcatctttggggtgccttgactggttgatcgatcgggaagcccgggcgatcgatgatggcaggcgcagctcatccgatgcatttctgcatggactccgactggctcaagggcatcgtccccgaggaccagggagggatggggtcgtcgtcgccgtcgggggagctgatcatcgcgtgcccggagccgatgcaggcccagcaggcggcggaccggcggctgcgcccgcagcacgaccagccgctcaagtgcccgcgctgcgactccacgcacaccaagttctgctactacaacaactacagcctctcccagccccgctacttctgcaagacgtgccgccgctactggaccaagggcggctccctccgcaacgtccccgtcggcggcggctgccgcaagaacaagcgcgccagcgccgccaagaagccctcggctgccgccgccatcgcgccgccgatttcgatgatgcagcagcttcatcacggccggcacatggcggagaccggcctccacctgtccttctctgggatgcagccgccggcggtctctgccgccgacccgctctgcagcctcgggctcttcgactggaagtacgaccacatcctctcgggttccggcggctttgagagcgcgaactctgaggctcacttcaccgggccaggcatgatgggcattgccaacggaagcggcggaggcggcgcagagtaccacgcactgaacgcgctccggtacgcagccggccttggagagcacctcgcgcttccgtttggtggcgcgacgtcgcgggctgagcgtgacagtgtcgtcgccgagatgaagccgcaggcggagaggctgctgtcgctggagtggtgcggcgaggcgagccgcgcgccgacggagacctccatcagctccctgggcgggctcggcctgtggagtgccatgatcaccggcgccgcccaccatcaccatggctcctctgccgccatctgaacgaggcgaagcatcgtgtcaacgcccccatgcacgcatgcatgcgttagtggtttgctaatacgcattgacgagtgcgaggactacgtagaagtgattgcctttttcttgcttgctccctgtgtggtttcatgcatgatctgctgctgtttcttttcctttgcttttgttcacatcgtttgtttggatcgatgtttgcaccccttatgtttcaagtgttgtactggacaatgttccgtgttgcacagcttcacacgttgctgtggctcgatcaattaagtttgtgacttgttgctgtcaaaaaaaaaaaaaaaa

SEQ ID NO: 336 - protein, 294 aa, Triticum aestivum
  misc_feature: Ceres CLONE ID NO.770468
  misc_feature (47)..(109): Pfam Name: zf-Dof Pfam Description: Dof domain, zinc finger
  misc_feature (1)..(294): Functional Homolog of  Ceres ANNOT NO.543998 at SEQ ID NO.327 with e-value of 1.69E-23 and BLAST sequence identity of 85.1
MDSDWLKGIVPEDQGGMGSSSPSGELIIACPEPMQAQQAADRRLRPQHDQPLKCPRCDSTHTKFCYYNNYSLSQPRYFCKTCRRYWTKGGSLRNVPVGGGCRKNKRASAAKKPSAAAAIAPPISMMQQLHHGRHMAETGLHLSFSGMQPPAVSAADPLCSLGLFDWKYDHILSGSGGFESANSEAHFTGPGMMGIANGSGGGGAEYHALNALRYAAGLGEHLALPFGGATSRAERDSVVAEMKPQAERLLSLEWCGEASRAPTETSISSLGGLGLWSAMITGAAHHHHGSSAAI

SEQ ID NO: 337 - DNA, 1763 bp, Glycine max
  misc_feature: Ceres CLONE ID no.1361038
  misc_feature: Encodes the peptide sequence at SEQ ID NO 338
tctcaaatcaacctttgcttttctctttcttttctttgaattttcatggctgtagctgctgtactggccaaaggtggtgtggatttttctcatgtcttttccttgaagcacaatcctgagttatttattctgggttttgggttgttcaaaagctgacacaaaatatcaacttccactagatttaagagttgtttgtatctttgatttaattcttttctagatagctatatatatatatgagaagatcttcatggtaacttcaaggtccacatatattgacattccatcttctctcttttcctaccaaagcaagttttttatcagcaaaagcactgcttttccttttccttccactagctttacctttttgctcgtgtgtgatcatttgttaaagagcacaaaaaattaaaagatactatttgttgttattattatttgattattgattcatttacatttttttaaaaaactttataattgtcttagtgggaagccttgctaccttgctttgatttttgttgttaattaacgatcttcaacaatcttttatgtaaacataaaatcaccaccagctatacctcttgaaattttttgttatggtatagattctaatcattctggggcgatcagtgtggtcgtgtaatacatgtactcacctcacataatgagataaggctttcttgttgatgttgtacagattcttgtcacatatgaaagcttataactataggtgtcctgtctctctctctctctctctctctcttttggggtttctcaggacaatattggacttattgtgagagtagtcatggaggggatggctcccaattcatgtgcaaggccagttctagagaaaaaaacaaggccacaagagcaactgaattgtccaaggtgcaattcaaccaacacaaagttctgttattacaacaactacagcctcacacagccaagatacttctgcaagacttgtagaaggtattggacagaaggagggtctctgagaaacgttccagttggaggtggttcaagaaagaacaagaaggtctctgtgacagcttcatcatcatcatcaccaaaggttccagacctaaacccaccaattaacctctcatcagtctcagctatctcctcacaaaaccctaaaataatgcatggtggccaagatctcaacctggctttcccagctatggaaaagtaccatcatggcatgccaccttatgttgagatgcaaaacagtgacaccaccaccactcatcatcatcaccaaacctcttcttcttgttctgctcctccagcttctctttcagctcttgagctacttaggtcaagcatggcatctaggggtttgaacccttatgctccttcttcttccttgatgccaaactcaacaaacagcaatgccctttactcatcagggtttcccatgcaagaagttaaacctagtcttaacttttcttcagctgatgggatgggaaatagatcatatgatcatcatcagattcaagagaggggtggtggcagacttttgttcccttttggagatgtcaagcagctttctgctgctgcaggtgctgatcaagtggaacacaataaagaacaacaagggaattcaactggttattggactggaatgattggtgaaggaacgtggtaagaaagaaaagaaaaaaagggaggacaaaggaaaattataagagaacatgcattaataacatttatatatatatatatatatatatcttcttttaaaaaaaaaaaaaaaa

SEQ ID NO: 338 - protein, 281 aa, Glycine max
  misc_feature: Ceres CLONE ID NO.1361038
  misc_feature (19)..(81): Pfam Name: zf-Dof Pfam Description: Dof domain, zinc finger
  misc_feature (1)..(281): Functional Homolog of  Ceres ANNOT NO.543998 at SEQ ID NO.327 with e-value of 8.40E-22 and BLAST sequence identity of 81.1
MEGMAPNSCARPVLEKKTRPQEQLNCPRCNSTNTKFCYYNNYSLTQPRYFCKTCRRYWTEGGSLRNVPVGGGSRKNKKVSVTASSSSSPKVPDLNPPINLSSVSAISSQNPKIMHGGQDLNLAFPAMEKYHHGMPPYVEMQNSDTTTTHHHHQTSSSCSAPPASLSALELLRSSMASRGLNPYAPSSSLMPNSTNSNALYSSGFPMQEVKPSLNFSSADGMGNRSYDHHQIQERGGGRLLFPFGDVKQLSAAAGADQVEHNKEQQGNSTGYWTGMIGEGTW

SEQ ID NO: 339 - DNA, 572 bp, Glycine max
  misc_feature: Ceres CLONE ID no.1371374
  misc_feature: Encodes the peptide sequence at SEQ ID NO 340
gacaaggtgaactctctctctctctctctctctctttctctctcaaatcaacctttgcttttctctttcttttctttgaattttcatggctgtagctgctgtactggccaaaggtggtgtggatttttctcatgtcttttccttgaagcacaatcctgagttatttattctgggttttgggttgttcaaaagctgacacaaaatatcaacttccactagatttaagagttgtttgtatctttgatttaattcttttctagatagctatatatatatatgagaagatcttcatggtaacttcaaggtccacatatattgacattccatcttctctcttttcctaccaaagcaagttttttatcagcaaaagcactgcttttccttttccttccactagctttacctttttgctcgtgtgtgatcatttgttaaagagcacaaaaaattaaaagatactatttgttgttattattatttgattattgattcatttacatttttttaaaaaactttataattgtcttagtgggaaccttgctactttgctttggatttttgttgttaattaacga

SEQ ID NO: 340 - protein, 281 aa, Glycine max; identical to SEQ ID NO: 338
  misc_feature: Ceres CLONE ID NO.1371374
  misc_feature (19)..(81): Pfam Name: zf-Dof Pfam Description: Dof domain, zinc finger
  misc_feature (1)..(281): Functional Homolog of  Ceres ANNOT NO.543998 at SEQ ID NO.327

SEQ ID NO: 341 - DNA, 852 bp, Arabidopsis thaliana
  misc_feature: Ceres ANNOT ID no.555366
  misc_feature: Ceres LOCUS ID At2g44680
  misc_feature: Encodes the peptide sequence at SEQ ID NO 342
atgtacaaggatcggagtggaggaggaataatgggtggtggtggatcatcgagatcggagatccttggtggagctattgatcggaaacgaatcaatgatgctttagacaaacatcttaagaaatcttcaccttctacatctagggttttcacttctaaggacaaagattctgtcccttctacttcaactgctaaatctcagcttcattctcgttcccccgatgttgaatctgacacggatagtgaaggatcagatgtgagtggttcagaaggtgatgatacctcttggatctcatggttttgtaatttgagagggaatgagtttttctgtgaagtagatgaagattatatacaagatgatttcaatctctgtggtttgagtggtcaagttccttactatgattatgcacttgatctcattttagatgttgaatcatcaaatggtgatatgtttactgaagaacagcatgagatggtggaatcagctgctgagatgttatatggtcttattcatgttcgttatattctcactactaaaggaatggctgctatgatggagaagtataagaattatgatttcgggagatgccccagagttttctgttgcggacagtcttgtcttccggttggccaatctgatatcccgaggtcgagcactgtgaagatatactgcccaaaatgcgaggatatttactacccgcgatctaaataccaaggcaacattgatggagcttactttggaactactttccctcatttgtttctcatggcctatgggaacatgaaaccgcagaagccggctcaaaactacgttcctaagatctttggctttaaggtacacaacaaacaatga

SEQ ID NO: 342 - protein, 283 aa, Arabidopsis thaliana
  misc_feature: Ceres ANNOT ID NO.555366
  misc_feature: Ceres LOCUS ID At2g44680
  misc_feature (96)..(270): Pfam Name: CK_II_beta Pfam Description: Casein kinase II regulatory subunit
  misc_feature (96)..(270): Pfam Name: CK_II_beta Pfam Description: Casein kinase II regulatory subunit
  misc_feature (1)..(283): Functional Homolog of  Ceres ANNOT NO.555366 at SEQ ID NO.342
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQGNIDGAYFGTTFPHLFLMAYGNMKPQKPAQNYVPKIFGFKVHNKQ

SEQ ID NO: 343 - DNA, 903 bp, Populus balsamifera subsp. trichocarpa
  misc_feature: Ceres ANNOT ID no.1496956
  misc_feature: Encodes the peptide sequence at SEQ ID NO 344
atgtacaaagatcgaggcgggtttggtggcgggtcatcaagatcggatattgtaggaggaccgcttgatcgaaagcgtataaatgatgcgctagacaagcatctagagaagtcttctccttcaacttcgagaggattgaataatagtagtaaggataaggagagattatctgttccttctacttctaccggtaaatcattacagcaccatcagcagcagcttgatcatcatcgtgctgattctcgctccgcttcgctttccaaaaacaaatgctctgatgaggaatctgagacagacagtgaggagtcggatgttagtggttctgatggagatgacacatcttggatctcgtggttttgcaatttgcgaggaaatgaatttttctgtgaagttgatgatgagtacattcaggatgattttaatctttgtggactgagcagtcaagttccatactatgattatgcacttgatcttatattggatgttgaatcttctcatggtgatatgttcactgaagaacagaatgagttggtggaatctgcagcagagatgctttacggtcttattcatgtgcgttacatacttactagcaaggggatgtctgccatgttggagaagtacaaaaactatgactttgggagatgcccacgagtttattgctgtggacagccctgcttcccagttggtcaatcagacattcctcgttcaagtactgtcaaaatctactgtccaaaatgtgaagacatctattaccctcgatccaagtatcaagacattgatggagcttattttggaacaacatttcctcacctatttttgatgacatatggtcacctaaagccacagaaggcaacacagagttacgtcccaagagtttttggcttcaaactccacaaaccttga

SEQ ID NO: 344 - protein, 300 aa, Populus balsamifera subsp. trichocarpa
  misc_feature: Ceres ANNOT ID NO.1496956
  misc_feature (115)..(288): Pfam Name: CK_II_beta Pfam Description: Casein kinase II regulatory subunit
  misc_feature (1)..(300): Functional Homolog of  Ceres ANNOT NO.555366 at SEQ ID NO.342 with e-value of 9.00E-121 and BLAST sequence identity of 85.4
MYKDRGGFGGGSSRSDIVGGPLDRKRINDALDKHLEKSSPSTSRGLNNSSKDKERLSVPSTSTGKSLQHHQQQLDHHRADSRSASLSKNKCSDEESETDSEESDVSGSDGDDTSWISWFCNLRGNEFFCEVDDEYIQDDFNLCGLSSQVPYYDYALDLILDVESSHGDMFTEEQNELVESAAEMLYGLIHVRYILTSKGMSAMLEKYKNYDFGRCPRVYCCGQPCFPVGQSDIPRSSTVKIYCPKCEDIYYPRSKYQDIDGAYFGTTFPHLFLMTYGHLKPQKATQSYVPRVFGFKLHKP

SEQ ID NO: 345 - DNA, 840 bp, Populus balsamifera subsp. trichocarpa
  misc_feature: Ceres ANNOT ID no.1538806
  misc_feature: Encodes the peptide sequence at SEQ ID NO 346
atgtacagagagcgagggattggtgtgtccaagacggacgtcgatcatcgaaagcagcggattagcgatgtcctcgataagcatctcgaccgatcctctccgtccagttccagacccaccaacggcaaggatttgtttcttttcatgaacaagcagcaaccgcctgatcacaacaacattgaccatctcctctctaaagacaacaacgcctccgttgtggaatctgacacggacagcgaagagtctgatgttagtggttccgatggagatgagacgtcgtggatctcatggttttgcagtctaagagggaatgaattcttttgtgaagttgatgatgattacatacaagatgattttaacctctgtgggttaagcagtcaagttccatactacgattatgcccttgatttgattttggatattgaatcctctcatggtgatatgttcacagaggaacagaatgaattggttgaatctgcagcagagatgctttatggattgattcatgctcgatatatattgaccagcaaagggatgacagctatgctggagaagtacaaaaactatgactttggaagatgccccagagtttgctgctgtggacaaccttgccttccagttggtcaatcagacattcctcggtcaagcactgttaaaatatgctgccccagatgtgatgatatatactacccacgttccaagtatcaagacattgatggagcttattttggaacgacatttcctcacctgtttttaatgactcacgggcatctcaagccgcaaaaggtagtgcagacctatgttcctagagtatttgggttcaagctacacaaaccataa

SEQ ID NO: 346 - protein, 279 aa, Populus balsamifera subsp. trichocarpa
  misc_feature: Ceres ANNOT ID NO.1538806
  misc_feature (94)..(267): Pfam Name: CK_II_beta Pfam Description: Casein kinase II regulatory subunit
  misc_feature (1)..(279): Functional Homolog of  Ceres ANNOT NO.555366 at SEQ ID NO.342 with e-value of 2.99E-104 and BLAST sequence identity of 76.9
MYRERGIGVSKTDVDHRKQRISDVLDKHLDRSSPSSSRPTNGKDLFLFMNKQQPPDHNNIDHLLSKDNNASVVESDTDSEESDVSGSDGDETSWISWFCSLRGNEFFCEVDDDYIQDDFNLCGLSSQVPYYDYALDLILDIESSHGDMFTEEQNELVESAAEMLYGLIHARYILTSKGMTAMLEKYKNYDFGRCPRVCCCGQPCLPVGQSDIPRSSTVKICCPRCDDIYYPRSKYQDIDGAYFGTTFPHLFLMTHGHLKPQKVVQTYVPRVFGFKLHKP

SEQ ID NO: 347 - DNA, 900 bp, Populus balsamifera subsp. trichocarpa
  misc_feature: Ceres ANNOT ID no.1539648
  misc_feature: Encodes the peptide sequence at SEQ ID NO 348
atgtacaaagatcgaggtgggtttggtggcgggtcatcaagatcggagattgttggaggacagcttgatcgaaagcgtataaatgatgcgctagacaagcatctagagaagtcttctccttcaacttcgagaggattgaataatagtagtaaggataaagaaagattgtctgttccttctacttccactggtaaatcatcacagcatcagcagcatcttgaacatcatcgtgctgattcccgctctgcttcgctatccaaaaacaaatgctctgatgaggaatctgagacagacagtgaggagtctgatgttagtggttctgatggagatgatacatcttggatctcatggttttgcaatttgcgtggaaatgaatttttctgtgaagttgatgacgagtacattcaggatgattttaatctttgtggattgagcagtcaagttccatactatgattatgcacttgatcttatattggatgttgaatcttctcatggtgatatgttcaccgaagaacagaatgagttggtggaatccgcagcagagatgctctacggtcttattcatgtgcgttacatacttactagcaaggggatgtctgcaatgttggaaaagtacaaaaactatgactttgggagatgcccacgagtttattgctgtggacagccctgccttccggttggtcaatcagacattcctcgttctagtactgtcaaaatctactgtccaaaatgtgaagacatctattaccctcgatccaagtatcaagacattgatggagcttattttggaaccacattccctcacctatttttgatgacatatggacacctaaagccacagaaagcaatacagagctacgttccaagagtttttggcttcaaactccacaagccttga

SEQ ID NO: 348 - protein, 299 aa, Populus balsamifera subsp. trichocarpa
  misc_feature: Ceres ANNOT ID NO.1539648
  misc_feature (114)..(287): Pfam Name: CK_II_beta Pfam Description: Casein kinase II regulatory subunit
  misc_feature (1)..(299): Functional Homolog of  Ceres ANNOT NO.555366 at SEQ ID NO.342 with e-value of 7.80E-122 and BLAST sequence identity of 86.1
MYKDRGGFGGGSSRSEIVGGQLDRKRINDALDKHLEKSSPSTSRGLNNSSKDKERLSVPSTSTGKSSQHQQHLEHHRADSRSASLSKNKCSDEESETDSEESDVSGSDGDDTSWISWFCNLRGNEFFCEVDDEYIQDDFNLCGLSSQVPYYDYALDLILDVESSHGDMFTEEQNELVESAAEMLYGLIHVRYILTSKGMSAMLEKYKNYDFGRCPRVYCCGQPCLPVGQSDIPRSSTVKIYCPKCEDIYYPRSKYQDIDGAYFGTTFPHLFLMTYGHLKPQKAIQSYVPRVFGFKLHKP

SEQ ID NO: 349 - DNA, 1256 bp, Zea mays subsp. mays
  misc_feature: Ceres CLONE ID no.275781
  misc_feature: Encodes the peptide sequence at SEQ ID NO 350
gtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatgctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgactttcaacctttgtggtctcagcagccaaagttccttattatgattatgctctcgatctcattttagatatcgagtcatctcatggtgatatgttcacttgaggaacaaaatgagctcgtagaatcagctgcagagatgctttatggtctgatacatgcacgatacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatrctgccccaagkgtgaagacatctactacccacggtccaagtaccaaggcaacatcgacggcgcatactttgggacaacgttccctcatctgttcctgatgacatacgagcacctcaagccacagaagctctcgcagcgctatgttcctcgtgtctttggcttcaagctccacaagccatgaacctcatgtatttgtcttttaaactcctcaagacgtggcactgggggcatgcgggagttttgcaatccttgaagacttgcatataagagcgccattggcaggtcagtggattggtaaaattctatcatgctgcagcgtgcttgtaccttagctggctggcacctatccaacatttgaatgtagctctmaggatatcaatgttgtaacctaactgctattgttctttgattagtaaaccaggagccccccctacaatgtagaatatgg

SEQ ID NO: 350 - protein, 273 aa, Zea mays subsp. mays
  misc_feature: Ceres CLONE ID NO.275781
  misc_feature (1)..(273): Functional Homolog of  Ceres ANNOT NO.555366 at SEQ ID NO.342
MYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKLSQRYVPRVFGFKLHKP

SEQ ID NO: 351 - DNA, 1386 bp, Zea mays
  misc_feature: Ceres CLONE ID no.281518
  misc_feature: Encodes the peptide sequence at SEQ ID NO 352
tgtttcctatcctttttcattcccacccgcccatcccttcaaaattcgctgcgtgtccctctctctccctgcgctcgtgctccgcccaggcccctttcctccaccgcgggcgcaaaccctaaccctacagccgctcgccccgcggcgcctgccaatggcgccccccgtgtgagtgtgtgtgagaggcagagacctagaggccgctacccggggaggagagggagggagagggagaggctgatagatgtataagcaggggggagcgggggtaggggctggtctggaccggaaacggatcagcgacgcgctagacaagcaccttgagaaggcggtcgcatcgccgtccacatcgagggggtcarcgggcggcggcggtgtgcgcgaccaccaccgcctcatcgtgccgtcctccgtgtcgtccatccccaagggccgctgctccgaaggggagtctgattctgatagtgaagcatcagatgttagtggctctgatggagaagacacctcgtggatttcatggtattgcaacttaagagggaatgagttcttctgtgaagtcgatgatgactacattcaagacgacttcaacctttgtggcctcagcagccaagttccttattatgattatgctcttgatctcattttagatattgaatcatctcatggtgatatgttcactgaggaacaaaatgagctcgtagaatcagctgcagagatgctttatgggctgatccatgcacgatacattctgaccagtaaagggctggctgcaatgctggagaagtataggaactatgacttcgggcggtgcccgcgtgtttactgctgtggtcaaccatgcctgccggttggacaatcagatattcatcgatgctagtaccgtgaaaatatactgccccaagtgtgaagacatctactacccacggtccaagtaccaaggcaacatcgacggcgcatattttgggacaacgttccctcacctgttcctgatgacatacgagcacctcaagctacagaascccttgcagcgcthtgttcctcgtgtctttggcttcaagctccataagccatgagcctcatgtatttggcttcaagctccataacccagagttttgcgagatcaaggtccttgaagactacatataagagcgccattggctacatataaaagcgctattgacagatcagtggattgataaaactccaccatgcagcggagcgcttttaccttacctggctggcacctaccaacatttgaatgtagctctaaggataccgatgttgttgtaacctaactgtaattgtttttttgattagtaaaccaggaccccgtacgatgtagagtatgggcattatttatggcttatgcaaaaaaaatcgttatgc

SEQ ID NO: 352 - protein, 275 aa, Zea mays
  misc_feature: Ceres CLONE ID NO.281518
  misc_feature (89)..(263): Pfam Name: CK_II_beta Pfam Description: Casein kinase II regulatory subunit
  misc_feature (89)..(263): Pfam Name: CK_II_beta Pfam Description: Casein kinase II regulatory subunit
  misc_feature (1)..(275): Functional Homolog of  Ceres ANNOT NO.555366 at SEQ ID NO.342 with e-value of 8.49E-109 and BLAST sequence identity of 77.2
MYKQGGAGVGAGLDRKRISDALDKHLEKAVASPSTSRGSAGGGGVRDHHRLIVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYRNYDFGRCPRVYCCGQPCLPVGQSDIHRSSTVKIYCPKCEDIYYPRSKYQGNIDGAYFGTTFPHLFLMTYEHLKLQKPLQRYVPRVFGFKLHKP

SEQ ID NO: 353 - DNA, 1320 bp, Glycine max
  misc_feature: Ceres CLONE ID no.471202
  misc_feature: Encodes the peptide sequence at SEQ ID NO 354
gcgaggaatagaaacgaaccgaaacggggaatcattgtctgcgtctgtaaattgtaaattgcatcatccctgaagctgaacctcaaaaccctagctgccggcttgtctgcaacggcatcgtttcagtatctcgttatgattagttgagaatccaaaggaatcgaatcgaatcatctcgacgagaagcaaaacaccggctatagttatgtacagagagcgaggaggcgtcggatccaaatcggaggtaacttccgttgatcggaagcgaatcaatgacgtcctcgataaacagctcgaacgatcctcgccgtccacatccagagccgccggcgccatcaacggcaaggaccgctcctcctcttccctcttagccgccgccaaggactcccgctccgcctccgtcaccgcccctatctccaagaattccaacgcttccgacgaggaatctgaaacagacagcgaggagtctgatgttagtggctccgacggagatgacacgtcgtggatctcgtggttctgcaatttgagaggaaatgaattcttctgcgaggttgatgacgattacatccaggacgacttcaacctctgtggattgagcagtcaagtgccttactatgattatgctctggatttgattttggatgttgaatcctctcatggtgacatgtttaccgaggaacagaatgagttaattgaatcagcagccgagatgctttatggtctgattcatgcccggtacatattgacaagcaaaggaatggctgcaatgctcgacaagtacaagaactatgattttggcagatgcccacgagtttactgctctggacaaccttgtattccagttggtcagtcagacatccctaggtctagtactgtgaaaatatactgccctcggtgtgaagacatttactatcctcggtccaagtatcaaggcaacattgatggagcttattttggaactacgtttcctcatctgttcttgatgacttatggacaactaaagccacagaaaccatcacagagctatgtcccgagagtttttggcttcaaacttcacaagccctgaagctgaaattttaagcttccatgaaagagcatgttgtaaagagaattgcagacgcgacatgtcatgcaagtgcttagtttcaatttcagcttggaattcagtgagcttcaagttcaatgagcaagtgcgtaatacttcaatgcactctaagtgcttattgcaaattgtattcttgcggttagttttaattaaagttgtttatgtttgtctcagattacagatactctactattttatattattttattccattt

SEQ ID NO: 354 - protein, 286 aa, Glycine max
  misc_feature: Ceres CLONE ID NO.471202
  misc_feature (1)..(286): Functional Homolog of  Ceres ANNOT NO.555366 at SEQ ID NO.342 with e-value of 8.80E-114 and BLAST sequence identity of 79.3
MYRERGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 355 - DNA, 1306 bp, Glycine max
  misc_feature: Ceres CLONE ID no.542752
  misc_feature: Encodes the peptide sequence at SEQ ID NO 356
aaaagttggcacctggcagcaagtagtagtaacaatttaggattgtggtgtgttgttgttgttgtagctatcagtaggtgaatccaaaaccctagccctcactctcaccaccattttttcaattcttgagctatgtttcagggataatagggcagggatgtacaaagaacgagagcgaggtggtgtttccgtttccgcctctaaatccgaggatcggaagcgaatcaacgacgttctcgataagcacttggaacgatcctctccttccacttcccgccccatcaacaccgcttccaagaattccaacctccaagtggaggaatctgagacggagagtgaagagtctgatgttagtggctctgatggggatgacacctcttggatctcgtggttctgtaatctaagagggaatgagttcttttgtgaggtggatgatgattacatacaggatgactttaacctctgtggattgagcagtcaagtgccctactttgattatgcccttgatttgattctcgacgttgagtcatcccatggtgacatgttcacggaggaacagaatgagttgattgaatcggcggcggaaatgctttatggtatgattcatgctcgatatgtgttgaccagcaaaggaatggctgccatgcttgacaaatacaagagctatgattttggtagatgcccaagagtttactgctctggacagccctgccttccagttggtcaatcggacattcctaggtcaagtactgtgaaaatatactgccctaggtgtgaagatctttactatccgcgttccaagtatcaaggcaacattgatggagcttactttggaacaacatttccacacctcttcttgatgacttatggacaactgaagccacagaaaccagcacaaggctatgttccgagagtttttgggttcaaagttcacaagccataaagccgaagttgaagctttcatgaaagtaaaaatctccccgtgtctcatttaactcttcttatggttctctttgcaacaacaggcgaatcatatgctttccaaaccagtacaatctaggcatctgttttacttgttataggagcttgttgtaaagaaatatgcagacatgtgaagcaagtgcttagtttcagcttctgattcaatgagcaagtgcttaggtactcgatggtacttcttaatggctttttacaaattgtattcttgcaattaacttaatattgtctatggttatgtctcgaattacaaataccctgctatttttatattgttttattccatttcaagaaaaaaaaaaaaaaaaaa

SEQ ID NO: 356 - protein, 261 aa, Glycine max
  misc_feature: Ceres CLONE ID NO.542752
  misc_feature (1)..(261): Functional Homolog of  Ceres ANNOT NO.555366 at SEQ ID NO.342 with e-value of 3.90E-111 and BLAST sequence identity of 79.9
MYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEMLYGMIHARYVLTSKGMAAMLDKYKSYDFGRCPRVYCSGQPCLPVGQSDIPRSSTVKIYCPRCEDLYYPRSKYQGNIDGAYFGTTFPHLFLMTYGQLKPQKPAQGYVPRVFGFKVHKP

SEQ ID NO: 357 - DNA, 1533 bp, Triticum aestivum
  misc_feature: Ceres CLONE ID no.570159
  misc_feature: Encodes the peptide sequence at SEQ ID NO 358
atggcatgcgctatatcttcctccccaaagtttgtcggaattacaaaacagcccccgtactcttcctccccacctctcgcctaccgttcgcgtcctccgcccgaggcctccacgggagcgccggagcgcacgcctgatctccccgcctcctcctcccggcaccgcggccccggctcctagcccgcctcacgatcgggggacgaggcacgagtaggagggcgagggtgcgaggagatgcagagggaccgaggcgtctcggcggccgctgggggcgccggtgagaggaagcggataggcgaggcgatggacaggtcctccccgtcgacgtcctgggggttctccggcggacgcgagagggaccggatcgccgccggcaagcagccggaggtgccccgctccggcggcggatccaccgccatgtccaagggcaagttgtccgatggagaatcggatactgacagtgaagaatcagatctcagtggttctgatggagaagatacatcgtggatttcatggttctgtagcttgcgaggcaatgagtttttctgtgaagttgatgacgattacatacaagacgatttcaatctctgtgggctaagcggtcaagttccatattatgaatatgctcttgatctgatattggatgtcgagtcttcacatggtgatatgttcacagaagagcagaatgaacttattgaatcagctgctgagatgctttatggattgattcatgttcgatatattcttacaagtaaaggattggctgcaatgttggataaatacaagaattatgactttggcagatgtccaagagtgcactgcagcggccagccatgccttccagttggccagtcggacattcctcgttctagtaatgtgaaaatttactgcccaaagtgtgaagatctctactatccgagatccaaatatcaaagcaacattgacggagcttactttgggacaacgtttcctcacttgtttctgatgacgtacccacatttgaagccccagaaaccgtcacagcagtacgtccccaaggtttttggcttcaaacttcataagccataacaagtttgaagactgaaggtgcaaaaggttcatagcagagttgtctgatatgtcacgctgcacatcacttccaagctgctcatttgtgcgcgtggcgcagtttagcacttggttcagttggttacccgtggcttggccgaaaccgacctgacctctggctgatttcccttgtcctccgttttcgctctcgcctgacgttctgatttgatccttgtggcttgtttagtgtagtagatttcttctatcctgttctttatactcattattatatttgagtttggcagttgctaaaagaaggcagttcgtaacagtgttatgtctctgctgtgtatttttcattttgttttacattaggttcctttgccaaaatgtgatggtaatggtaatctgaaacattcgatccggctattcttattcttcacctgcaactgagtttgtatggaaagtttaaaaaaaaaaaaaaaa

SEQ ID NO: 358 - protein, 277 aa, Triticum aestivum
  misc_feature: Ceres CLONE ID NO.570159
  misc_feature (1)..(277): Functional Homolog of  Ceres ANNOT NO.555366 at SEQ ID NO.342 with e-value of 1.60E-105 and BLAST sequence identity of 78.5
MQRDRGVSAAAGGAGERKRIGEAMDRSSPSTSWGFSGGRERDRIAAGKQPEVPRSGGGSTAMSKGKLSDGESDTDSEESDLSGSDGEDTSWISWFCSLRGNEFFCEVDDDYIQDDFNLCGLSGQVPYYEYALDLILDVESSHGDMFTEEQNELIESAAEMLYGLIHVRYILTSKGLAAMLDKYKNYDFGRCPRVHCSGQPCLPVGQSDIPRSSNVKIYCPKCEDLYYPRSKYQSNIDGAYFGTTFPHLFLMTYPHLKPQKPSQQYVPKVFGFKLHKP

SEQ ID NO: 359 - DNA, 1151 bp, Glycine max
  misc_feature: Ceres CLONE ID no.643751
  misc_feature: Encodes the peptide sequence at SEQ ID NO 360
aacaatttaggattgtggtgtgttgttgttgttgtagctatcagtagggataatagggcagggatgtacaaagaacgagagcgaggtggtgtttccgtttccgcctctaaatccgaggatcggaagcgaatcaacgacgttctcgataagcacttggaacgatcctctccttccacttcccgccccatcaacaccgcttccaagaattccaacctccaagtggaggaatctgagacggagagtgaagagtctgatgttagtggctctgatggggatgacacctcttggatctcgtggttctgtaatctaagagggaatgagttcttttgtgaggtggatgatgattacatacaggatgactttaacctctgtggattgagcagtcaagtgccctactttgattatgcccttgatttgattctcgacgttgagtcatcccatggtgacatgttcacggaggaacagaatgagttgattgaatcggcggcggaaatgctttatggtatgattcatgctcgatatgtgttgaccagcaaaggaatggctgccatgcttgacaaatacaagagctatgattttggtagatgcccaagagtttactgctctggacagccctgccttccagttggtcaatcggacattcctaggtcaagtactgtgaaaatatactgccctaggtgtgaagatctttactatccgcgttccaagtatcaaggcaacattgatggagcttactttggaacaacatttccacacctcttcttgatgacttatggacaactgaagccacagaaaccagcacaaggctatgttccgagagtttttgggttcaaagttcacaagccataaagccgaagttgaagctttcatgaaagtaaaaatctccccgtgtctcatttaactcttcttatggttctctttgcaacaacaggcgaatcatatgctttccaaaccagtacaatctaggcatctgttttacttgttataggagcttgttgtaaagaaatatgcagacatgtgaagcaagtgcttagtttcagcttctgattcaatgagcaagtgcttaggtactcgatggtacttcttaatggctttttacaaattgtattcttgcaattaacttaatattgtctatggttatgtctcgaatt

SEQ ID NO: 360 - protein, 282 aa, Glycine max
  misc_feature: Ceres CLONE ID NO.643751
  misc_feature (1)..(282): Functional Homolog of  Ceres ANNOT NO.555366 at SEQ ID NO.342 with e-value of 3.90E-111 and BLAST sequence identity of 79.9
NNLGLWCVVVVVAISRDNRAGMYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEMLYGMIHARYVLTSKGMAAMLDKYKSYDFGRCPRVYCSGQPCLPVGQSDIPRSSTVKIYCPRCEDLYYPRSKYQGNIDGAYFGTTFPHLFLMTYGQLKPQKPAQGYVPRVFGFKVHKP

SEQ ID NO: 361 - DNA, 1173 bp, Glycine max
  misc_feature: Ceres CLONE ID no.1023028
  misc_feature: Encodes the peptide sequence at SEQ ID NO 362
ctctccatctcgttcctcccccacctgcgcagccaagaagttcaaaccctagtccagcctgcgagcgccgacacgtcgcgccgtgcggcttcccgcaagcaggggctcgggccgaccgcgggggatgagcggcgcagcctacagggaccggggattcggcggcgccgcggagatggaccggaagcgcatcaaggaggcgctcgagaagcacacggagaggccgtccccgtccacctccaggggggcgtccagggagaaggagctgctcgccgccggcaagataaccactcagatcggcaaggtccccaaggtctccgacgtcgaggaattcgaaactgacagtgaagattctgatgttagtggttctgaaggagaggacacatcttggatttcatggttctgtagcttgcgaggcaacgaattcttctgtgagattgatgatgattatatacaggatgatttcaatctctgtggcctaagcagtcaggtgccatattatgattatgcacttgatctcatcctagacattgagtcttctaatggtgatgtattcactgaggagcaaaatgaattaattgagtcatctgcagagatgctgtatggtttaattcatgcacgttacatcttaaccagcaagggtctagctgcaatgttagagaagttcaagaactatgattttggcagatgccctcgagtatactgctgtggtcaaccctgtcttccagcaggacaatcagacattcctaggtcaagcacagtgaaggtgttttgtccaaaatgtgaagatttacactatccaaggtccaagtaccaaggcaacattgatggagcatactttggtacgacattccctcatctcttcttgatgacatacccacacctgaagccacagaagccatcacagcaatatgttccaagagtttttggcttcaaacttcacaagcaatcatgacgaacttttaccagtgagcgctatttgtttttacctagtgttagagatggaacaccttggcctgaaaatgttgtggcctcttgattcgagtactcgcgagctcgaatcttgctgtaaactgctgagcaactgtatctgttttgttgtatgactgttgtgtaatctaggtttcctcacttgatcaatctatgcacatttgcatgttaaaaaaaaaaaaaaaa

SEQ ID NO: 362 - protein, 259 aa, Glycine max
  misc_feature: Ceres CLONE ID NO.1023028
  misc_feature (72)..(246): Pfam Name: CK_II_beta Pfam Description: Casein kinase II regulatory subunit
  misc_feature (1)..(259): Functional Homolog of  Ceres ANNOT NO.555366 at SEQ ID NO.342 with e-value of 4.19E-107 and BLAST sequence identity of 74.2
MDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLILDIESSNGDVFTEEQNELIESSAEMLYGLIHARYILTSKGLAAMLEKFKNYDFGRCPRVYCCGQPCLPAGQSDIPRSSTVKVFCPKCEDLHYPRSKYQGNIDGAYFGTTFPHLFLMTYPHLKPQKPSQQYVPRVFGFKLHKQS

SEQ ID NO: 363 - DNA, 1164 bp, Triticum aestivum
  misc_feature: Ceres CLONE ID no.1032174
  misc_feature: Encodes the peptide sequence at SEQ ID NO 364
ctctctcctctccatctcgttcctcccccacctgcgcagccaagaagttcaaaccctagtccagcctgcgagcgccgacacgtcgcgccgtgcggcttcccgcaagcaggggctcgggccgaccgcgggggatgagcggcgcagcctacagggaccggggattcggcggcgccgcggagatggaccggaagcgcatcaaggaggcgctcgagaagcacacggagaggccgtccccgtccacctccaggggggcgtccagggagaaggagctgctcgccgccggcaagataaccactcagatcggcaaggtccccaaggtctccgacgtcgaggaattcgaaactgacagtgaagattctgatgttagtggttctgaaggagaggacacatcttggatttcatggttctgtagcttgcgaggcaacgaattcttctgtgagattgatgatgattatatacaggatgatttcaatctctgtggcctaagcagtcaggtgccatattatgattatgcacttgatctcatcctagacattgagtcttctaatggtgatgtattcactgaggagcaaaatgaattaattgagtcatctgcagagatgctgtatggtttaattcatgcacgttacatcttaaccagcaagggtctagctgcaatgttagagaagtycaagaactatgattttggcagatgccctcgagtatactgctgtggtcaaccctgtcttccagcaggacaatcagacattcctaggtcaagcacagtgaaggtgttttgtccaaaatgtgaagatttacactatccaaggtccaagtaccaaggcaatattgatggagcatactttggtacgacattccctcatctcttcttgatgacatacccacacctgaagccacagaagccatcacagcaatatgttccaagagtttttggcttcaaacttcacaagcaatcatgacgaacttttaccagtgagcgctatttgtttttacctagtgttagagatggaacaccttggcctgaaaatgttgtggcctcttgattcgagtactcgcgagctcgaatcttgctgtaaactgctgagcaactgtatctgttttgttgtatgactgttgtgtaatctaggtttcctcacttgatcaatctatgcacatttgcatgtc

SEQ ID NO: 364 - protein, 275 aa, Triticum aestivum
  misc_feature: Ceres CLONE ID NO.1032174
  misc_feature (88)..(262): Pfam Name: CK_II_beta Pfam Description: Casein kinase II regulatory subunit
  misc_feature (1)..(275): Functional Homolog of  Ceres ANNOT NO.555366 at SEQ ID NO.342 with e-value of 2.89E-108 and BLAST sequence identity of 72.7
  misc_feature (180)..(180): Xaa is any aa, unknown, or other
MSGAAYRDRGFGGAAEMDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLILDIESSNGDVFTEEQNELIESSAEMLYGLIHARYILTSKGLAAMLEKXKNYDFGRCPRVYCCGQPCLPAGQSDIPRSSTVKVFCPKCEDLHYPRSKYQGNIDGAYFGTTFPHLFLMTYPHLKPQKPSQQYVPRVFGFKLHKQS

SEQ ID NO: 365 - DNA, 864 bp, Populus balsamifera subsp. trichocarpa
  misc_feature: Ceres ANNOT ID no.1486236
  misc_feature: Encodes the peptide sequence at SEQ ID NO 366
atgtacaaagatcgaggtgggtttggtggcgggtcatcaagatcggagattgttggaggacagcttgatcgaaagcgtataaatgatgcgctagacaagcatctagagaagtcttctccttcaacttcgagaggattgaataatagtagtaaggataaagaaagattgtctgttccttctacttccactggtaaatcatcacagcatcagcagcatcttgaacatcatcgtgctgattcccgctctgcttcgctatccaaaaacaaatgctctgatgcttgtttggtggtatgggatcttgaggaatctgagacagacagtgaggagtctgatgttagtggttctgatggagatgatacatcttggatctcatggttttgcaatttgcgtggaaatgaatttttctgtgaagttgatgacgagtacattcaggatgattttaatctttgtggattgagcagtcaagttccatactatgattatgcacttgatcttatattggatgttgaatcttctcatggcttcacaaagttccagactggaccgcttcttctatgcatttgcacattctcaggtgatatgttcaccgaagaacagaatgagttggtggaatccgcagcagagatgctctacggtcttattcatgtgcgttacatacttactagcaaggggatgtctgcaatgttggaaaagtacaaaaactatgactttgggagatgcccacgagtttattgctgtggacagccctgccttccggttggtcaatcagacattcctcgttctagtactgtcaaaatctactgtccaaaatgtgaagacatctattaccctcgatccaagtatcaaggcagtatccttccatga

SEQ ID NO: 366 - protein, 287 aa, Populus balsamifera subsp. trichocarpa
  misc_feature: Ceres ANNOT ID NO.1486236
  misc_feature (122)..(287): Pfam Name: CK_II_beta Pfam Description: Casein kinase II regulatory subunit
  misc_feature (1)..(287): Functional Homolog of  Ceres ANNOT NO.555366 at SEQ ID NO.342 with e-value of 1.40E-97 and BLAST sequence identity of 87.3
MYKDRGGFGGGSSRSEIVGGQLDRKRINDALDKHLEKSSPSTSRGLNNSSKDKERLSVPSTSTGKSSQHQQHLEHHRADSRSASLSKNKCSDACLVVWDLEESETDSEESDVSGSDGDDTSWISWFCNLRGNEFFCEVDDEYIQDDFNLCGLSSQVPYYDYALDLILDVESSHGFTKFQTGPLLLCICTFSGDMFTEEQNELVESAAEMLYGLIHVRYILTSKGMSAMLEKYKNYDFGRCPRVYCCGQPCLPVGQSDIPRSSTVKIYCPKCEDIYYPRSKYQGSILP

SEQ ID NO: 367 - DNA, 1231 bp, Zea mays
  misc_feature: Ceres CLONE ID no.1486490
  misc_feature: Encodes the peptide sequence at SEQ ID NO 368
cagccgcccacctcacgcaagcggcaagcccacgggcgctctctctccccctgcgcctcgtcgcctctccaatccctctcgtcctctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgccatattatgattatgcacttgatctcatcttagacattgagtcttctaatgatgacgggtttaccgaggagcaaaatgaattaatcgagtcatctgcagagatgctgtacggtttaattcatgcacgatacattttaaccagcaagggtctagctgcaatgttggagaagttcaagaactacgactttggtagatgccccagggtgtactgctgtggccagccctgccttccagcagggcaatcagatgttcctagatcgagcactgtgaagatatattgtccgaaatgcgaagaacttaactatccaagatccaagtaccaaggcaacatcgatggatcatactttgggacgacattccctcatcttttcctgatgacttactcgcacttgaagccgcagaagccgtcacagcaatacactccaagggttttcggcttcaaacttcacaagccgtcatgacagagttgtagcttccgccagaagcacccctgtcacctaggttttagggagagcatcgtggccttcaaatactgttgtattattgatgtacgaattcgcgagcctgggcctcgctgtaaactattgtgaaattgtatcttttttccgatattattactgttgtgcaaaaaaaaaaaaaaaa

SEQ ID NO: 368 - protein, 259 aa, Zea mays
  misc_feature: Ceres CLONE ID NO.1486490
  misc_feature (1)..(259): Functional Homolog of  Ceres ANNOT NO.555366 at SEQ ID NO.342 with e-value of 3.30E-107 and BLAST sequence identity of 74.1
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPS

SEQ ID NO: 369 - DNA, 717 bp, Gossypium hirsutum
  misc_feature: Ceres CLONE ID no.1914315
  misc_feature: Encodes the peptide sequence at SEQ ID NO 370
atttttaccccaatttgtctcctttccctcttcttcatccccaccttcttcaacctccgacttttttttctttatattctcaaataaaaaccgttttttgcttcatccccaccctgcgaaaaccctttaatttctcaattccagggctttttcttcatgttactctcccctcacggcgccatgaatccaaaaaagcttgattttttgcccctgcattgaaaaaagttgggagcttttgcgaatttgcgttgtgaaaggtaaaaaaaaaaaaaagttatgtatagtcatagagatcgaggaggaggaaggggaggaccgttggatcggaagcgcataaacgatgcgctggacaagtcttccccgtccacttcgaggggcttcaacagcaaagacaaaggaagaccctctgttccttcaacttccgctggtaaatccctgctttctcatcgcgattcacgttccaaagccaaatgttctgctgaggagtcagaaaccgacagtgaagaatcagacgttagtggttccgagggagatgacacgtcttggatttcatggttttgcggtttgcgaggcaatgagttcttttgtgaagttgatgatgaatacatccaagatgacttcaatctttgcgggttgagcagtcaagttccatattatgactacgcccttgatttaatattggatgttgaatcttctcatggtgatatgttcaccgaa

SEQ ID NO: 370 - protein, 276 aa, Gossypium hirsutum
  misc_feature: Ceres CLONE ID NO.1914315
  misc_feature (1)..(276): Functional Homolog of  Ceres ANNOT NO.555366 at SEQ ID NO.342 with e-value of 2.00E-114 and BLAST sequence identity of 85.0
MYSHRDRGGGRGGPLDRKRINDALDKSSPSTSRGFNSKDKGRPSVPSTSAGKSLLSHRDSRSKAKCSAEESETDSEESDVSGSEGDDTSWISWFCGLRGNEFFCEVDDEYIQDDFNLCGLSSQVPYYDYALDLILDVESSHGDMFTEEQNELVESAAEMLYGLIHVRYILTSKGMSAMLEKYKSYDFGRCPRVYCCGQSCLPVGQSDIPRASTVKIYCAKCEDVYYPRSKYQGNIDGAYFGATFPHLFLMTYGHLKPQKATQNYIPRVFGFKIHKP

SEQ ID NO: 371 - protein, 276 aa, Arabidopsis thaliana
  misc_feature: Public GI ID NO.7576201
  misc_feature (90)..(264): Pfam Name: CK_II_beta Pfam Description: Casein kinase II regulatory subunit
  misc_feature (1)..(276): Functional Homolog of  Ceres ANNOT NO.555366 at SEQ ID NO.342
MYKERSGGGGGGSSRSEILGGAIDRKRINDALNKKLEKSSTSTTTSRVFSSKDKDPFSFTSTKTQLPDVESETDSEGSDVSGSEGDDTSWISWFCNLRGNDFFCEVDEDYIQDDFNLCGLSGQVPYYDYALDLILDVDASNSEMFTDEQHEMVESAAEMLYGLIHVRYILTTKGMAAMTEKYKNCDFGRCPRVFCCGQSCLPVGQSDIPRSSTVKIYCPKCEDISYPRSKFQGNIDGAYFGTTFPHLFLMTYGNLKPQKPTQSYVPKIFGFKVHKP

SEQ ID NO: 372 - protein, 260 aa, Zea mays
  misc_feature: Public GI ID NO.11527002
  misc_feature (72)..(247): Pfam Name: CK_II_beta Pfam Description: Casein kinase II regulatory subunit
  misc_feature (1)..(260): Functional Homolog of  Ceres ANNOT NO.555366 at SEQ ID NO.342 with e-value of 4.80E-106 and BLAST sequence identity of 74.1
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYYDFGRCPRVYCCGQPCLPAGQSDVPRSSTVKIYCPKCEELNYPRSKYQGNIDGSYFGTTFPHLFLMTYPHLKPQKPSQQYTPRVFGFKLHKPS

SEQ ID NO: 373 - protein, 280 aa, Nicotiana tabacum
  misc_feature: Public GI ID NO.21261784
  misc_feature (94)..(268): Pfam Name: CK_II_beta Pfam Description: Casein kinase II regulatory subunit
  misc_feature (94)..(268): Pfam Name: CK_II_beta Pfam Description: Casein kinase II regulatory subunit
  misc_feature (1)..(280): Functional Homolog of  Ceres ANNOT NO.555366 at SEQ ID NO.342 with e-value of 7.60E-124 and BLAST sequence identity of 85.5
MYRDRGGGSSKSEIVGGPLDRKRINDALDKHLEKSSPSTSRAFKDKAVPSTSAGKSHQHHPDHRATKNKCSDDESETDSEESDVSGSDGEDTSWISWFCNLRGNEFFCEVDDEYIQDDFNLCGLSSQVPYYDYALDLILDVESSHGDMFTEEQNELVESAAEMLYGLIHVRYILTSKGMAAMLEKYKNYDFGRCPRVYCCGQPCLPVGQSDIPRSSTVKIYCPKCEDIYYPRSKYQGNIDGAYFGTTFPHLFLMTYGHLKPQKSTQNYVPRVFGFKLHKT

SEQ ID NO: 374 - protein, 275 aa, Nicotiana tabacum
  misc_feature: Public GI ID NO.45238341
  misc_feature (94)..(263): Pfam Name: CK_II_beta Pfam Description: Casein kinase II regulatory subunit
  misc_feature (94)..(263): Pfam Name: CK_II_beta Pfam Description: Casein kinase II regulatory subunit
  misc_feature (1)..(275): Functional Homolog of  Ceres ANNOT NO.555366 at SEQ ID NO.342 with e-value of 6.89E-114 and BLAST sequence identity of 85.4
MYRDRGGGGGGGGPLDRKRINDALDKHLEKLSPSTSRSLKDKAVPSTSASAGGGGGKSHFDHRNTSKNKCSDEESETDSEESDVSGSDGDDTSWISWFCNLRGNEFFCEVDDDYIQDDFNLCGLSSQVPYYDYALDLILDVESSHEEQNELVESAAEMLYGLIHVRYILTTKGMAAMLEKYKNYDFGRCPRVYCSGQPCLPVGQSDIPRSSTVKIYCPKCEDIYYPRSKYQGNIDGAYFGTTFPHLFLMTYGHLKPQKPTQNYTPRVFGFKIHKT

SEQ ID NO: 375 - protein, 279 aa, Oryza sativa subsp. japonica
  misc_feature: Public GI ID NO.78709019
  misc_feature (92)..(266): Pfam Name: CK_II_beta Pfam Description: Casein kinase II regulatory subunit
  misc_feature (92)..(266): Pfam Name: CK_II_beta Pfam Description: Casein kinase II regulatory subunit
  misc_feature (1)..(279): Functional Homolog of  Ceres ANNOT NO.555366 at SEQ ID NO.342
MSGAYRDRGFGGAAAEMDRKRIKDVLEKHLDRSSPSTSRGAAVAKERDRLAAAGGKLPAPLGKAGKVSDGEEFETDSEDSDVSGSEGEDTSWISWFCSLRGNEFFCEIDDDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEDLHYPRSKYQGNIDGAYFGTTFPHLFLMTYPHLKPQKPSQQYVPKVFGFKLHKQS

SEQ ID NO: 376 - DNA, 643 bp, Glycine max
  misc_feature: Ceres CLONE ID no.535483
  misc_feature: Encodes the peptide sequence at SEQ ID NO 377
atgattcatgctcgatatgtgttgaccagcaaaggaatggctgccatgcttgacaaatacaagagctatgattttggtagatgcccaagagtttactgctctggacagccctgccttccagttggtcaatcggacattcctaggtcaagtactgtgaaaatatactgccctaggtgtgaagatctttactatccgcgttccaagtatcaaggcaacattgatggagcttactttggaacaacatttccacacctcttcttgatgacttatggacaactgaagccacagaaaccagcacaaggctatgttccgagagtttttgggttcaaagttcacaagccataaagccgaagttgaagctttcatgaaagtaaaaatctccccgtgtctcatttaactcttcttatggttctctttgcaacaacaggcgaatcatatgctttccaaaccagtacaatctaggcatctgttttacttgttataggagcttgttgtaaagaaatatgcagacatgtgaagcaagtgcttagtttcagcttytgattcaatgagcaagtgcttaggtactcgatggkactttttaatggctttttacaaattgtattyttgcaattaacttaatattgtytawggttatgtytcg

SEQ ID NO: 377 - protein, 261 aa, Glycine max; identical to SEQ ID NO: 356
  misc_feature: Ceres CLONE ID NO.535483
  misc_feature (75)..(249): Pfam Name: CK_II_beta Pfam Description: Casein kinase II regulatory subunit
  misc_feature (75)..(249): Pfam Name: CK_II_beta Pfam Description: Casein kinase II regulatory subunit
  misc_feature (1)..(261): Functional Homolog of  Ceres ANNOT NO.555366 at SEQ ID NO.342

SEQ ID NO: 378 - DNA, 1286 bp, Triticum aestivum
  misc_feature: Ceres CLONE ID no.702573
  misc_feature: Encodes the peptide sequence at SEQ ID NO 379
gaaattggcgccacctccctcccgtgctcgcccctcgcctgggctctcgacccatccctgctcgaaccctaacctcagatggcgcttcccgcgtgagagaacgctgccgcggcagcagcgttgaggggggcttcgtcgtagtcagcgcgacagatgtataagcagggggcggccggaggtgcggggccggaccggaagcgcatcagcgacgcgctcgataagcacctggagaaggcggccgcgtcgccctccacgtcgagaggctcggcgggtgcccgaggcaaccacaaccgcgtcgtagtgccgtcctccatccccaagggccgctgctccgaaggggagtctgaatctgacagtgaagcatcagatgttagtggctctgatggagaagacacctcatggatttcatggtattgcaacctaagagggaatgagttcttctgtgaagtcgatgatgattacattcaagatgacttcaatctttgtgggcttagcagtcaagttccatattatgattatgctcttgatctcattttagatatcgagtcttctcatggtgatattttcacagaagaacaaaatgagctagtggaatcagctgctgagatgttgtatgggctaattcatgcgcgatacattctgaccagtaaagggttggctgctatgctggagaaatacaagaactatgactttggacgatgtccacgggtttattgctgtggccaaccatgtctaccagttggacaatcggatattcaccgatctagtacagtgaagatatactgtcctaagtgcgaagacatctactatccacggtctaaataccaaggcaatattgatggagcctactttgggacaacatttcctcacctgtttctgatgacgtacgatcacctcaagccccagaagccctcgcagcgctatgttcctcgcgtatttggcttcaagctccacaaccacaagccatgatgcggaggtgaaggaaaagataagaggccccggaagactactgtaagagtgcaatcgccagatcatgctgcccacccatattgtgtgccctgtctggtctatttaacattgaaatattggtataaaagaagacatgagacgatgttgtaacctaattccagctctactggctagtaaatctggacctctgtttccaaaaccagcagctatcgagaaatcaaagttatggtcgaaaaaaaaaaaaaaaaaaaaaaaaaaaaaaaaaaaaaaaaaaaaaaaaaaaaaaaaaaaaaaaaaacccaaaaaaaaaaaaaaaa

SEQ ID NO: 379 - protein, 271 aa, Triticum aestivum
  misc_feature: Ceres CLONE ID NO.702573
  misc_feature (83)..(257): Pfam Name: CK_II_beta Pfam Description: Casein kinase II regulatory subunit
  misc_feature (83)..(257): Pfam Name: CK_II_beta Pfam Description: Casein kinase II regulatory subunit
  misc_feature (1)..(271): Functional Homolog of  Ceres ANNOT NO.555366 at SEQ ID NO.342 with e-value of 4.09E-109 and BLAST sequence identity of 80.7
MYKQGAAGGAGPDRKRISDALDKHLEKAAASPSTSRGSAGARGNHNRVVVPSSIPKGRCSEGESESDSEASDVSGSDGEDTSWISWYCNLRGNEFFCEVDDDYIQDDFNLCGLSSQVPYYDYALDLILDIESSHGDIFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYDHLKPQKPSQRYVPRVFGFKLHNHKP

SEQ ID NO: 380 - DNA, 1282 bp, Zea mays
  misc_feature: Ceres CLONE ID no.1222371
  misc_feature: Encodes the peptide sequence at SEQ ID NO 381
tctctaatttcctttctctctcaagcttctcagaaagtctgacactttcgagaatctaatctccaaatttcttgtctttttggagaaggaatcgaattatgtacaaggaacgtagtggaggaggtggtggtgggtcatcgagatcagagatcctcggtggagctattgatcggaaacgaatcaacgatgcactcaataagaaactagagaaatcttcaacttccaccaccacatctagggttttctcttctaaagacaaagatcccttttccttcacatctactaaaactcagcttcctgatgtggaatcggaaactgatagtgaagggtctgatgtgagtggatcggagggtgatgatacgtcgtggatctcttggttttgtaatttgagagggaatgatttcttctgtgaagtcgatgaagattatattcaagatgatttcaatctttgtggtttaagtggtcaagtcccttactatgattatgcacttgatctcattttagatgttgatgcttccaacagtgagatgtttactgatgaacagcatgaaatggtggaatcagctgctgagatgctatatggtcttattcatgttcgttacattttgactactaaaggaatggctgcaatgactgagaagtacaagaactgtgatttcgggagatgcccgagagttttctgttgcggtcagtcttgtcttccagttggacaatccgatatcccgagatcgagtactgtgaagatatactgccctaaatgcgaggatatatcttacccgcgatctaaattccaaggcaatattgatggagcgtactttggaaccacattccctcacttgttcttgatgacttacgggaacttaaagccgcagaagcctactcaaagctatgtcccaaaaatctttggcttcaaggtacacaaaccatgatactagtgctctgcattctcaatggatacatttagtggctctgtaattgcatccggatgagcaactgaaatgatagctgcggtgactggagcatacatcaaccattgggttagaggatgagagctgaagttgaaagatggaatcttgaaagaatctcatgaagttccaagaaaacttagaagtgcaacagcctggctcattgggggaaaagaacgacatacttgggtcttgttgttgtctccgaaaagattttccccagttagttggattttgttttgaactgttggattattattcgtttttctaatttcatgtaaaactcataaatttcaactgaagtataacttagatcg

SEQ ID NO: 381 - protein, 276 aa, Zea mays; identical to SEQ ID NO: 371
  misc_feature: Ceres CLONE ID NO.1222371
  misc_feature (90)..(264): Pfam Name: CK_II_beta Pfam Description: Casein kinase II regulatory subunit
  misc_feature (1)..(276): Functional Homolog of  Ceres ANNOT NO.555366 at SEQ ID NO.342 with e-value of 1.60E-130 and BLAST sequence identity of 90.4

SEQ ID NO: 382 - protein, 288 aa, Oryza sativa
  misc_feature: Public GI ID NO.34901776
  misc_feature (102)..(276): Pfam Name: CK_II_beta Pfam Description: Casein kinase II regulatory subunit
  misc_feature (102)..(276): Pfam Name: CK_II_beta Pfam Description: Casein kinase II regulatory subunit
  misc_feature (1)..(288): Functional Homolog of  Ceres ANNOT NO.555366 at SEQ ID NO.342
MYKQGGGGGGGGGGGGGAGLDRKRISDALDKHLEKAVAAAAAAASPSTSRGSAGGRGGGDHQRLVVPSSASSMPKGRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 383 - DNA, 1305 bp, Arabidopsis thaliana
  misc_feature: Ceres CLONE ID no.32842
  misc_feature: Ceres LOCUS ID At5g52250
  misc_feature: Encodes the peptide sequence at SEQ ID NO 384
atagtttcgtgtggacctaactaaaactagtcgtaactcattcatggaggctttgttctgctctgagatacccaacaacaacatcagatcttccattaacgatctatcttcttcttcttcatatacatggccaatgatcatgacctcctcttcttcttcttcttcatctcccacaatcatgaacatagagaacattcctagatgcgactgggatctctctctttccgccgttgtttcctccgcatccaccggatcagacgctatcggagcaatcgagttcgaccctaccggagagatcatagctacgggaggaatcgcaagaaagatcagatcgtatcgtttaagctctttgttagagtcacgtgacgatcacgtaacagcttcagagagctgtatttgcacgccggcgaagcttagtagtctcaaatggagacccgatttttccggtcgggttatcgggtcaggagattacgacggagttgtcaccgagtacgacgtggagaaacaagtgcctgtttccgagagagacgagcatggaggtagaaggatttggagcgtggactacacgctttacaatggctctcttctaggcgcgtcaggctccgacgacggaacggttcaaatgtgggatccacgtaacggagggacgttagaagaaacggttaggcccggtggtggagcggcgatttgttcggtagagttcgatccgttcggtggatcttccatagccgttggatgtgctgaccagaatgcctacgtgtatgacatcagaagactagtggaccctttgatcgtattagacggccataccaaaacggtgacgtatgctcgattcatggattctcacacgatcgttaccggttcgaccgacgggagcttgaagcaatgggatatagataatggacggcgcgtggttcgcacgtaccgagggcatgtgaatagccggaactttgttgggttgtcggtttggagacatggtggtttggtcgtgtccgggtcagagaataaccaagtgtttgtgtacgataagaggtgggaggaaccggtttgggtttgtggattgggtcatacgaaccggtttggatctgaccgacggtttgttagtagtgtgtgtttgagacaagtggatgaagattggtgcacacttgtggccggaggatccgatggggctttagaaattttctcgggcaaacagagctaatcagtatttatattatttttttctgctcatgattaatacaaactgtttttcagttgattttatactgtctatagttattaattttaatatgattgaatgttact

SEQ ID NO: 384 - protein, 385 aa, Arabidopsis thaliana
  misc_feature: Ceres CLONE ID NO.32842
  misc_feature: Ceres LOCUS ID At5g52250
  misc_feature (247)..(283): Pfam Name: WD40 Pfam Description: WD domain, G-beta repeat
  misc_feature (1)..(385): Functional Homolog of  PUBLIC GI NO.79518327 at SEQ ID NO.399 with e-value of 4.29E-113 and BLAST sequence identity of 67.1
MEALFCSEIPNNNIRSSINDLSSSSSYTWPMIMTSSSSSSSSPTIMNIENIPRCDWDLSLSAVVSSASTGSDAIGAIEFDPTGEIIATGGIARKIRSYRLSSLLESRDDHVTASESCICTPAKLSSLKWRPDFSGRVIGSGDYDGVVTEYDVEKQVPVSERDEHGGRRIWSVDYTLYNGSLLGASGSDDGTVQMWDPRNGGTLEETVRPGGGAAICSVEFDPFGGSSIAVGCADQNAYVYDIRRLVDPLIVLDGHTKTVTYARFMDSHTIVTGSTDGSLKQWDIDNGRRVVRTYRGHVNSRNFVGLSVWRHGGLVVSGSENNQVFVYDKRWEEPVWVCGLGHTNRFGSDRRFVSSVCLRQVDEDWCTLVAGGSDGALEIFSGKQS

SEQ ID NO: 385 - DNA, 1107 bp, Arabidopsis thaliana
  misc_feature: Ceres ANNOT ID no.570714
  misc_feature: Ceres LOCUS ID At5g23730
  misc_feature: Encodes the peptide sequence at SEQ ID NO 386
atgaacactcttcatcctcacaagcagcaacaagaacaagcacaacaacaagaagaagctagatacgaatgggatctttctctctccaccgtcgtatcttcctcctcctcctccgcctccgacgttatcggagctattgaattcgatcccactgataacatcgtcgctaccgccgggatttcaagaaagattcgtttttacggcctcccttctcttttacgtaacaacgctgtctccggtaccggagtttccttcgtcgatcaagccaccgcctgcgaatattacatctgtactccggcgaaacttagtagtctccggtggagacccgggtcgggcggtcgggttattgggtcgggagattacgacggcgtagtgatggagtacgatcttgagaagaggacgccggtattcgaaagggacgagcacggtggtcgtcgtgtatggagcgtagattacactcgtcacggcggcgcttcgacggtgggcgcgtcgggatcggatgacgggactatgcaagtatgggatccgaggtgtccgccggaagaatctgtcggtgttgtacgaccggcggggatttgccggagtgctgtttgttgcgtcgagttcgatccttccggtggaccagccgtggccgtcggatgcgctgatcggaaagggtacgtttacgatataaggaaactcgttgacccggcgttgactttacaaggtcatacgaaaacggtgtcgtatgtgaggttcctcgacggtgggacggtggtgacggcaggtacggacggttgtttgaagctgtggagcgtggaggatgggcgcgtgattcgcacgtacgaagggcatgtgaataatcggaacttcgtggggttatctgtgtggagaaacggcgcgttgtttggttgtggatcggaaaacaacagggtgtttgtgtacgataggagatgggggaagccggtttgggtagatgggtttgaaccagttggtatgaattctggttcggataagcggttcgtgagtagcgtctgttggaggcaatcaggtgtggaccagtgtaccctagtggctggaggatctgatggagtattacaggtttacgtgggcaaaagaaaaccatag

SEQ ID NO: 386 - protein, 368 aa, Arabidopsis thaliana
  misc_feature: Ceres ANNOT ID NO.570714
  misc_feature: Ceres LOCUS ID At5g23730
  misc_feature (229)..(265): Pfam Name: WD40 Pfam Description: WD domain, G-beta repeat
  misc_feature (1)..(368): Functional Homolog of  Ceres CLONE NO.32842 at SEQ ID NO.384
  misc_feature (1)..(368): Functional Homolog of  PUBLIC GI NO.79518327 at SEQ ID NO.399 with e-value of 4.29E-113 and BLAST sequence identity of 67.1
MNTLHPHKQQQEQAQQQEEARYEWDLSLSTVVSSSSSSASDVIGAIEFDPTDNIVATAGISRKIRFYGLPSLLRNNAVSGTGVSFVDQATACEYYICTPAKLSSLRWRPGSGGRVIGSGDYDGVVMEYDLEKRTPVFERDEHGGRRVWSVDYTRHGGASTVGASGSDDGTMQVWDPRCPPEESVGVVRPAGICRSAVCCVEFDPSGGPAVAVGCADRKGYVYDIRKLVDPALTLQGHTKTVSYVRFLDGGTVVTAGTDGCLKLWSVEDGRVIRTYEGHVNNRNFVGLSVWRNGALFGCGSENNRVFVYDRRWGKPVWVDGFEPVGMNSGSDKRFVSSVCWRQSGVDQCTLVAGGSDGVLQVYVGKRKP

SEQ ID NO: 387 - DNA, 1215 bp, Oryza sativa
  misc_feature: Ceres ANNOT ID no.1375154
  misc_feature: Encodes the peptide sequence at SEQ ID NO 388
atgagcaacccctcctcgccggccacgtccaccgccgccggggagcagcagctgcacgatcaggatcaccgggacgaggcggcgctgcagcaagaacacgccgccgccggcattattcccgacgacgaggacaagctgtcgccgccgaggtgcgaatgggagtttcgcctggcggccaccgtgccgtcgccggcgctcgcgggcgcgtccgactccatcggcagcctcgacttcgaccccaccggccgccacctcgccaccggcggcatcgcccggaagatccggatttacagggtcgccgagccgtctagccccgccgcctgcatctgcgtcccggccaagctgagcagcgtgcggtggcgccctggcggcggcgaggcggtggcggcgtcgcacgtggggtgcggcgactacgacggcgtcgtgacggagtacgacgtggagcgcggcgtgccggtctgggagcgcgacgagcacgaggggcggcgggtgtgggcgctcgactacgcccgcggcggcggcgcggcgacgatggtggcgtccgggtcggacgaccggacagcccacgtgtgggacccgcgcgccccggctggcgcggcggggtcgtgggcgacggcgcgcgccggcggcgccgtgctgtgcgtggagttcgaccccgccggcgggccgcagctggcggtgggctccgccgaccgccgcgccgcggtgcacgacgtgcgcgcgctggggcgcggcgcggtggcgtccatggacggccacggccgcgccgtgacgtacgtccggtgggcggcgacggcgcggcgggtggtgacgtcggcggcggacggcacccaccgtctgtgggcgctgccggcgccggcggcggcggagacggcggcgagggaggtgcggtcgtacagcggccacgtcagcgggcgaagcttcgtggggatgggggtgtggcgtggcgcggggctgatcgccagcggctccgagtccggccacgtcttcgtctacgacctccgctggtccaagcccatctgggtccacccattctcccacgccgacgccttcgtcagcgcggtcgcatggcgccagctcgccggcgacgacagcgacggccagctcgtcgccggcggctccgacggcgtgctcaagctcttcaccacccaccgccgtctcacccccgacgtcgccggcgtcgggggcgacgacgacgacgacgtggctgcatga

SEQ ID NO: 388 - protein, 404 aa, Oryza sativa
  misc_feature: Ceres ANNOT ID NO.1375154
  misc_feature (1)..(404): Functional Homolog of  Ceres CLONE NO.32842 at SEQ ID NO.384 with e-value of 3.00e-113 and BLAST sequence identity of 67.2
  misc_feature (1)..(404): Functional Homolog of  PUBLIC GI NO.79518327 at SEQ ID NO.399 with e-value of 4.29E-113 and BLAST sequence identity of 67.1
MSNPSSPATSTAAGEQQLHDQDHRDEAALQQEHAAAGIIPDDEDKLSPPRCEWEFRLAATVPSPALAGASDSIGSLDFDPTGRHLATGGIARKIRIYRVAEPSSPAACICVPAKLSSVRWRPGGGEAVAASHVGCGDYDGVVTEYDVERGVPVWERDEHEGRRVWALDYARGGGAATMVASGSDDRTAHVWDPRAPAGAAGSWATARAGGAVLCVEFDPAGGPQLAVGSADRRAAVHDVRALGRGAVASMDGHGRAVTYVRWAATARRVVTSAADGTHRLWALPAPAAAETAAREVRSYSGHVSGRSFVGMGVWRGAGLIASGSESGHVFVYDLRWSKPIWVHPFSHADAFVSAVAWRQLAGDDSDGQLVAGGSDGVLKLFTTHRRLTPDVAGVGGDDDDDVAA

SEQ ID NO: 389 - DNA, 1368 bp, Populus balsamifera subsp. trichocarpa
  misc_feature: Ceres ANNOT ID no.1474370
  misc_feature: Encodes the peptide sequence at SEQ ID NO 390
atgaaaaacttctccagtaaattccatccttatagtcatcagcacacacaagaatctcaaaaccaagaaacaagaaaacaaaaggaaaccatagaggaggaggaggaagaaagagcaaggtgtgaatgggatttcagtctctccacaatagtttcatcaagcaacaataacaacactgcatccatatcagatgctttaggggtgatcgaattcgaccagacgaatagcatcatcgccacagctaagcttagtagtttccgatggaaacccaggtcagacggtcgggttctagggtccggagactacgacggggtggtgatggaatataatcttgagaggagaataccaatctttgaacgcgatgaacatggcgggcgaagggtttggagcgtggactattcacattgcgatccgactatgggtgcatccgggtcggatgatggaaccatgcaaatgtgggacacacgcagtgagagtggggaatgtgtggctacggttcaacctagcgtgagacgcagtgccgtctgttgcgtggagtttaatccatttggtggaccaatagtagccatcggatgtgctgaccgcaaggtatacgggtatgatcttcgaatgatggctgacccagtatttgttcttgatgggcataggaagaccgtgacatacatcaaatttcttgataatgctacattagtatctgcaagcattgatggatgcttgaaactatggaattcggacaattcgaacgtaattcggacctaccacgggcacgtcaacaatcggaactttgttggattatcagtgtggaggaatggaggcttgctagggtgtggatcagaaaacaataaggtttttgtgtatgacaagagatggagtgaaccagtatgggttcacgagtctagtagcccaataatgggtaaagataggtgtggcagtgggtttgttagtagtgtgtgctggaggcaagtgggggaagaccaatgcacacttgtaacaggaggatcagatgggatcttgcaatgttccattaaattatttgcaattccatcacgtacgaaattcatccgacaaggactacagtttacatggcttattgagcgtgcaataacatcagtggagaatgcaaaagacaaaggagaaaaggaagagcagtggttggcggtggaaacggtagaggccggtggtgagctgctctccactgttcacatgcaacgtgaacaatggagaatgcaaaagacgaaggagaaggggaaggggaagggaaagaggaagaggaagagtagtggttggcggtggaaacgacggagggcggtgtttgcaactcagcacaaaaagcaacttcaagttgcttttggttgtcctgcggtttaa

SEQ ID NO: 390 - protein, 455 aa, Populus balsamifera subsp. trichocarpa
  misc_feature: Ceres ANNOT ID NO.1474370
  misc_feature (207)..(243): Pfam Name: WD40 Pfam Description: WD domain, G-beta repeat
  misc_feature (1)..(455): Functional Homolog of  Ceres CLONE NO.32842 at SEQ ID NO.384 with e-value of 3.69E-87 and BLAST sequence identity of 62.5
  misc_feature (1)..(455): Functional Homolog of  PUBLIC GI NO.79518327 at SEQ ID NO.399 with e-value of 4.29E-113 and BLAST sequence identity of 67.1
MKNFSSKFHPYSHQHTQESQNQETRKQKETIEEEEEERARCEWDFSLSTIVSSSNNNNTASISDALGVIEFDQTNSIIATAKLSSFRWKPRSDGRVLGSGDYDGVVMEYNLERRIPIFERDEHGGRRVWSVDYSHCDPTMGASGSDDGTMQMWDTRSESGECVATVQPSVRRSAVCCVEFNPFGGPIVAIGCADRKVYGYDLRMMADPVFVLDGHRKTVTYIKFLDNATLVSASIDGCLKLWNSDNSNVIRTYHGHVNNRNFVGLSVWRNGGLLGCGSENNKVFVYDKRWSEPVWVHESSSPIMGKDRCGSGFVSSVCWRQVGEDQCTLVTGGSDGILQCSIKLFAIPSRTKFIRQGLQFTWLIERAITSVENAKDKGEKEEQWLAVETVEAGGELLSTVHMQREQWRMQKTKEKGKGKGKRKRKSSGWRWKRRRAVFATQHKKQLQVAFGCPAV

SEQ ID NO: 391 - DNA, 1437 bp, Populus balsamifera subsp. trichocarpa
  misc_feature: Ceres ANNOT ID no.1527790
  misc_feature: Encodes the peptide sequence at SEQ ID NO 392
atgaaaaacttctccagtaaattccatccttatagtcatcagcacacacaagaatctcaaaaccaagaaacaagaaaacaaaaggaaaccatagaggaggaggaggaagaaagagcaaggtgtgaatgggatttcagtctctccacaatagtttcatcaagcaacaataacaacactgcatccatatcagatgctttaggggtgatcgaattcgaccagacgaatagcatcatcgccacagaccatgccagggctcgtgactattatatttgtaccccagctaagcttagtagtttccgatggaaacccaggtcagacggtcgggttctagggtccggagactacgacggggtggtgatggaatataatcttgagaggagaataccaatctttgaacgcgatgaacatggcgggcgaagggtttggagcgtggactattcacattgcgatccgactatgggtgcatccgggtcggatgatggaaccatgcaaatgtgggacacacgcagtgagagtggggaatgtgtggctacggttcaacctagcgtgagacgcagtgccgtctgttgcgtggagtttaatccatttggtggaccaatagtagccatcggatgtgctgaccgcaaggtatacgggtatgatcttcgaatgatggctgacccagtatttgttcttgatgggcataggaagaccgtgacatacatcaaatttcttgataatgctacattagtatctgcaagcattgatggatgcttgaaactatggaattcggacaattcgaacgtaattcggacctaccacgggcacgtcaacaatcggaactttgttggattatcagtgtggaggaatggaggcttgctagggtgtggatcagaaaacaataaggtttttgtgtatgacaagagatggagtgaaccagtatgggttcacgagtctagtagcccaataatgggtaaagataggtgtggcagtgggtttgttagtagtgtgtgctggaggcaagtgggggaagaccaatgcacacttgtaacaggaggatcagatgggatcttgcaatgttccattaaattatttgcaattccatcacgtacgaaattcatccgacaaggactacagtttacatggcttattgagcgtgcaataacatcagtggagaatgcaaaagacaaaggagaaaaggaagagcagtggttggcggtggaaacggtagaggccggtggtgagctgctctccactgttcacatgcaacgtgaacaatggagaatgcaaaagacgaaggagaaggggaaggggaagggaaagaggaagaggaagagtagtggttggcggtggaaacgacggagggcggtggtaaaacacattgcggttaaaaaaaaaaacaaattgcaccttaaagtggcaataaaaaaaaaagagaatgtgatttttacaagttaa

SEQ ID NO: 392 - protein, 478 aa, Populus balsamifera subsp. trichocarpa
  misc_feature: Ceres ANNOT ID NO.1527790
  misc_feature (220)..(256): Pfam Name: WD40 Pfam Description: WD domain, G-beta repeat
  misc_feature (1)..(478): Functional Homolog of  Ceres CLONE NO.32842 at SEQ ID NO.384 with e-value of 4.80E-94 and BLAST sequence identity of 62.2
  misc_feature (1)..(478): Functional Homolog of  PUBLIC GI NO.79518327 at SEQ ID NO.399 with e-value of 4.29E-113 and BLAST sequence identity of 67.1
MKNFSSKFHPYSHQHTQESQNQETRKQKETIEEEEEERARCEWDFSLSTIVSSSNNNNTASISDALGVIEFDQTNSIIATDHARARDYYICTPAKLSSFRWKPRSDGRVLGSGDYDGVVMEYNLERRIPIFERDEHGGRRVWSVDYSHCDPTMGASGSDDGTMQMWDTRSESGECVATVQPSVRRSAVCCVEFNPFGGPIVAIGCADRKVYGYDLRMMADPVFVLDGHRKTVTYIKFLDNATLVSASIDGCLKLWNSDNSNVIRTYHGHVNNRNFVGLSVWRNGGLLGCGSENNKVFVYDKRWSEPVWVHESSSPIMGKDRCGSGFVSSVCWRQVGEDQCTLVTGGSDGILQCSIKLFAIPSRTKFIRQGLQFTWLIERAITSVENAKDKGEKEEQWLAVETVEAGGELLSTVHMQREQWRMQKTKEKGKGKGKRKRKSSGWRWKRRRAVVKHIAVKKKNKLHLKVAIKKKENVIFTS

SEQ ID NO: 393 - DNA, 1173 bp, Populus balsamifera subsp. trichocarpa
  misc_feature: Ceres ANNOT ID no.1468856
  misc_feature: Encodes the peptide sequence at SEQ ID NO 394
atgaaaaacctctccactaaattccatcggcatagtcaccaccacacacaagaatctgaaaaccacgaaaaagaagccatagaggaagaacaagaacaacaagaagaaaaagctaggtgtgaatgggatttcagtctcacaacaattgtttcatcaggaaacaacaatatcagtagtactccagccatatcggatgctctaggggtgattgaattcgaccagacgaacagcatcattgccacaggtggaatagcaagaaagataagaatttacaacttcaagtctttgtttgcacatgaaaatactagccaaaatgcgcacgaaattacttgcttagaccatgctagggcttgtgactattatatttgtaccccagctaagcttagtagcatccgatggaaacccagttcggacgggcgggttctagggtccggagactacgacggggtggtgatggaatattgtcttgagaggagaataccaatcttcgaacgagatgaacatggcgggcgacgggtttggagtgtggactactcacattgggatccggttttgggtgcatccgggtcggatgatggaaccatgcaaatgtgggacacacgttgcgagagtggggagggcgtggctactgttcagcctggtgtgggtcgcagtgccgtgtgttgcgtggagttcaatccatttggtggaccaatagtagccgtcggatgcgctgacagaagggtatacgggtacgacattcgaatgacgggtgacccggtatttgttcttgatgggcataggaagaccgtgacgtacattaaatttctcgataatgttacattggtgtctgctagcattgatggatgcttgaagctatgggattcggataattcaaacgtaatccggtcatacaaggggcacgtcaacagccggagcttcatcggattgtcagtgtggaggaatggaggcttattagggtgtgggtcagaaaacaataaggtttttgtgtatgacagaagatggggcgagccaatatgggttcacgagtctaacccagtgggtagggatgggtgtggcggcgggttcgttagcagtgtgtgctggaggcaagtggaggaagaccagtgcacgctcgtggcaggaggatcagatggggacttgcaagtttttcaaggcagaaggaagtcatag

SEQ ID NO: 394 - protein, 390 aa, Populus balsamifera subsp. trichocarpa
  misc_feature: Ceres ANNOT ID NO.1468856
  misc_feature (252)..(288): Pfam Name: WD40 Pfam Description: WD domain, G-beta repeat
  misc_feature (1)..(390): Functional Homolog of  Ceres CLONE NO.32842 at SEQ ID NO.384 with e-value of 9.39E-105 and BLAST sequence identity of 61.3
  misc_feature (1)..(390): Functional Homolog of  PUBLIC GI NO.79518327 at SEQ ID NO.399 with e-value of 4.29E-113 and BLAST sequence identity of 67.1
MKNLSTKFHRHSHHHTQESENHEKEAIEEEQEQQEEKARCEWDFSLTTIVSSGNNNISSTPAISDALGVIEFDQTNSIIATGGIARKIRIYNFKSLFAHENTSQNAHEITCLDHARACDYYICTPAKLSSIRWKPSSDGRVLGSGDYDGVVMEYCLERRIPIFERDEHGGRRVWSVDYSHWDPVLGASGSDDGTMQMWDTRCESGEGVATVQPGVGRSAVCCVEFNPFGGPIVAVGCADRRVYGYDIRMTGDPVFVLDGHRKTVTYIKFLDNVTLVSASIDGCLKLWDSDNSNVIRSYKGHVNSRSFIGLSVWRNGGLLGCGSENNKVFVYDRRWGEPIWVHESNPVGRDGCGGGFVSSVCWRQVEEDQCTLVAGGSDGDLQVFQGRRKS

SEQ ID NO: 395 - DNA, 1384 bp, Gossypium hirsutum
  misc_feature: Ceres CLONE ID no.1919410
  misc_feature: Encodes the peptide sequence at SEQ ID NO 396
aatgaacgatttctcctccggattccatccccccgccgtcccaggccatgaaaccaaactatccgcagaagaaaaacaaccagccgctcgttgtgagtgggatttttcactcgccaccgttgtctcctccaccgccaacgccaccgtctctgacacccttggagtcatcgaattcgacccttctaataccatcttagcaaccggagggattgcaaggaagattaggatttacactttgaattctttgttgcggcctcaagaagagactgtccattctcaaggtaagcaccaaagtattgcgtttctagaccatactaatgcgtgtgataattgcatctttaccccagctaagcttagtagccttaggtggaaacccgggaccggaggccgcatcttgggttccggagactacgacggtgtggtcatggagtatgatatagagacgaagttgccaatcttcgaacgtgacgagcatggtgggaggcgggtttggagcgtcgactattctcattcggatccgttcctcggggcatctggctcggacgatggcaccatgcaaatgtgggacccacgctgcggcgaaggagggggaagtgtggctaaggtgcagcccacgaagtcacgcagctcggtttgttgcgtggagttcaaccccttcggagatgcattgatagccgccggatgcgccgacaagaaggcctacgtctatgatgtacggaaaatggtggagcccgtacacattttcgatggacatacgaaaaccataacatacgttagatttctgaatgcccaaacactggtttccgctggaaccgacgggtgtttaaaactatggaatatcgttgattctcgtttacttagaacatacaaagggcacgtaaacagtcggagctttgtggggttgtcagtttggaggcatggagggttgcttggatgcggatcagaaaataaccaggtgttcgtttatgataccaggtggggtgagcccatttgggtgcatggcttcgagcctgtgggtagagatagctccgaccatcagcatgctttcgtcagcagtgtgtgctggaggcaagtcaatgaagaccagtgcacacttgttgcaggtggttccaatggggttttacacgttttcgtgggcaagaggaaatctgattcagagtagcccatgtttggaaacatgaccttccttttcctctcatcttagggatcttatattactccaactaaaattttcatgtccatcaagaatgtaatattcaaagttgaatctgcattctccatattttactgttgtagcttatacttttcggttgaattataagatttgacactattatttaattaattaagaaaaaaaagggatggaggcccatcaaaggaaggc

SEQ ID NO: 396 - protein, 386 aa, Gossypium hirsutum
  misc_feature: Ceres CLONE ID NO.1919410
  misc_feature (243)..(279): Pfam Name: WD40 Pfam Description: WD domain, G-beta repeat
  misc_feature (1)..(386): Functional Homolog of  Ceres CLONE NO.32842 at SEQ ID NO.384 with e-value of 9.99E-108 and BLAST sequence identity of 62.1
  misc_feature (1)..(386): Functional Homolog of  PUBLIC GI NO.79518327 at SEQ ID NO.399 with e-value of 4.29E-113 and BLAST sequence identity of 67.1
MNDFSSGFHPPAVPGHETKLSAEEKQPAARCEWDFSLATVVSSTANATVSDTLGVIEFDPSNTILATGGIARKIRIYTLNSLLRPQEETVHSQGKHQSIAFLDHTNACDNCIFTPAKLSSLRWKPGTGGRILGSGDYDGVVMEYDIETKLPIFERDEHGGRRVWSVDYSHSDPFLGASGSDDGTMQMWDPRCGEGGGSVAKVQPTKSRSSVCCVEFNPFGDALIAAGCADKKAYVYDVRKMVEPVHIFDGHTKTITYVRFLNAQTLVSAGTDGCLKLWNIVDSRLLRTYKGHVNSRSFVGLSVWRHGGLLGCGSENNQVFVYDTRWGEPIWVHGFEPVGRDSSDHQHAFVSSVCWRQVNEDQCTLVAGGSNGVLHVFVGKRKSDSE

SEQ ID NO: 397 - protein, 404 aa, Oryza sativa subsp. japonica; identical to SEQ ID NO: 388
  misc_feature: Public GI ID NO.41052591
  misc_feature (245)..(282): Pfam Name: WD40 Pfam Description: WD domain, G-beta repeat
  misc_feature (1)..(404): Functional Homolog of  Ceres CLONE NO.32842 at SEQ ID NO.384 with e-value of 7.20E-75 and BLAST sequence identity of 52.6
  misc_feature (1)..(404): Functional Homolog of  PUBLIC GI NO.79518327 at SEQ ID NO.399 with e-value of 4.29E-113 and BLAST sequence identity of 67.1

SEQ ID NO: 398 - DNA, 1107 bp, Arabidopsis thaliana; identical to SEQ ID NO: 385
  misc_feature: Public GI ID NO.79518327

SEQ ID NO: 399 - protein, 368 aa, Arabidopsis thaliana; identical to SEQ ID NO: 386
  misc_feature: Public GI ID NO.79518327
  misc_feature (229)..(265): Pfam Name: WD40 Pfam Description: WD domain, G-beta repeat
  misc_feature (1)..(368): Functional Homolog of  Ceres CLONE NO.32842 at SEQ ID NO.384 with e-value of 4.29E-113 and BLAST sequence identity of 67.1
  misc_feature (1)..(368): Functional Homolog of  PUBLIC GI NO.79518327 at SEQ ID NO.399 with e-value of 3.00e-113 and BLAST sequence identity of67.2

SEQ ID NO: 400 - DNA, 665 bp, Arabidopsis thaliana
  misc_feature: Ceres CLONE ID no.251923
  misc_feature: Ceres LOCUS ID At1g57660
  misc_feature: Encodes the peptide sequence at SEQ ID NO 401
aagggtttcgtcagagacagaagtgagagaggaggaaaaatgccggcgggacacggagtagggcgagaacaagagatctgttcgcgagaccattcaggaagaagggttatattccactctccacttacctcagaaccttcaaagtcggcgattacgtcgatgtcaaggttaatggagctatccacaagggtattcctcataagttctaccatggtcgtactggtcgcatctggaatgtcactaagcgtgccgttggtgttgaagtcaacaaacagattgggaacagaatcataaggaagaggatacatgtgcgtgtggagcatgtgcaacagtcaaggtgtgctgaggagtttaaactcagaaagaagcagaacgatgtgcttaaggctgatgctaaagccagaggagagactatcagcaccaagagacagcctaaaggtcctaaaccgggtttcatggtcgaaggtatgacattggagactgtcactcccattccttacgatgttgtcaacgatctcaagggtggttattgagttgtttccatttttttatcattctctactcagaatttttgcacttgcttttttaatgatgtttttgtatcaaacaagagtgaattctatatggtatgagttcatattttgttaggaaagatggtttatccc

SEQ ID NO: 401 - protein, 164 aa, Arabidopsis thaliana
  misc_feature: Ceres CLONE ID NO.251923
  misc_feature: Ceres LOCUS ID At1g57660
  misc_feature (2)..(100): Pfam Name: Ribosomal_L21e Pfam Description: Ribosomal protein L21e
MPAGHGVRARTRDLFARPFRKKGYIPLSTYLRTFKVGDYVDVKVNGAIHKGIPHKFYHGRTGRIWNVTKRAVGVEVNKQIGNRIIRKRIHVRVEHVQQSRCAEEFKLRKKQNDVLKADAKARGETISTKRQPKGPKPGFMVEGMTLETVTPIPYDVVNDLKGGY

SEQ ID NO: 402 - DNA, 495 bp, Populus balsamifera subsp. trichocarpa
  misc_feature: Ceres ANNOT ID no.1447803
  misc_feature: Encodes the peptide sequence at SEQ ID NO 403
atgccagctggacatggtttgcgatcaaggaccagagatctcttcgctcgtcccttcaggaagaagggttacatccctctcaccacatacctcagaacgtacaaggtaggcgactatgtcgacattaaggtaaatggcgctgtccacaaaggcatgccccacaagttctaccatggccgcaccggtcgcgtctggaatgtaaccaagcgcgctattggtgtcgtcatcaacaagcaggttgggaataggattattgggaagagaattcatgttagggtggagcatgtgcagccgtcgaggtgcagggaggagttcaagttgaggaagaagaagaatgatgagttgaaggcggaggccaaagctcgtggtgaaaagattagtactaagagacagcctcaaggaccgaagcccggatttatggtggagggtgctactcttgagactttcactcccattccttatgatgtggtcaatgatctcaagggtggttattga

SEQ ID NO: 403 - protein, 164 aa, Populus balsamifera subsp. trichocarpa
  misc_feature: Ceres ANNOT ID NO.1447803
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 5.20E-77 and BLAST sequence identity of 86.5
MPAGHGLRSRTRDLFARPFRKKGYIPLTTYLRTYKVGDYVDIKVNGAVHKGMPHKFYHGRTGRVWNVTKRAIGVVINKQVGNRIIGKRIHVRVEHVQPSRCREEFKLRKKKNDELKAEAKARGEKISTKRQPQGPKPGFMVEGATLETFTPIPYDVVNDLKGGY

SEQ ID NO: 404 - DNA, 616 bp, Arabidopsis thaliana
  misc_feature: Ceres CLONE ID no.251776
  misc_feature: Ceres LOCUS ID At1g09590
  misc_feature: Encodes the peptide sequence at SEQ ID NO 405
atatataaaccctaatcacatttcgcaaccaccaaagcggaggaaaaatgccggctggacatggagttcgagcgagaacgagggatctgttcgcgaggcctttcaggaagaagggttacattcctctatcgacttacctgaggaccttcaaggtcggcgattacgtcgatgtgaaggtgaatggtgcgatccacaagggtatgcctcacaagttctaccatggtcgtactggtcgtatctggaacgtcaccaagcgcgccgtcggtgttgaagtcaacaaacagattgggaacaggatcataaggaagaggattcatgttcgtgtggagcatgtgcagcagtcaagatgtgccgaggagttcaagctgaggaagaagaaaaacgatgagctcaaggctgcagccaaagccaatggtgagaccatcagcaccaagagacagcctaaaggacccaaaccaggattcatggtcgaaggaatgaccttggagactgtcactccaatcccctacgatgtcgtcaacgatctcaaaggaggctattagttctatcttcttgtgctttagaactctttttcatatgttttgtagcagacttaaaactaagaattatgatttac

SEQ ID NO: 405 - protein, 164 aa, Arabidopsis thaliana
  misc_feature: Ceres CLONE ID NO.251776
  misc_feature: Ceres LOCUS ID At1g09590
  misc_feature (1)..(164): Functional Homolog of  Ceres CLONE NO.251923 at SEQ ID NO.401 with e-value of 7.80E-83 and BLAST sequence identity of 96.9
MPAGHGVRARTRDLFARPFRKKGYIPLSTYLRTFKVGDYVDVKVNGAIHKGMPHKFYHGRTGRIWNVTKRAVGVEVNKQIGNRIIRKRIHVRVEHVQQSRCAEEFKLRKKKNDELKAAAKANGETISTKRQPKGPKPGFMVEGMTLETVTPIPYDVVNDLKGGY

SEQ ID NO: 406 - DNA, 788 bp, Zea mays
  misc_feature: Ceres CLONE ID no.303105
  misc_feature: Encodes the peptide sequence at SEQ ID NO 407
aaaccctagcgccacccacccacccacccactcgcttcagccgcctccgccgcgcgtacaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagcgcggcgaggttatcagcaccaagaggcagccattgggtcccaagcccggcttcatggtcgagggcaccaccattgagaccgtaactcccatcccatatgatgtggtcaatgatctcaagggtggatactaggttgtttggtccatctacctgcagtacccagttctacatctgtgttactctagtgcgtgcaactttgctcactctgagcagtagtatgaacctgttgtctgttcctgttgaaagatttcccattttaggtgcaaacctgagtttctccgaacgcgttataccctgaccttgcttctgagaacgaagatgtgctatttttacaaaaaaaaaaaaaaaa

SEQ ID NO: 407 - protein, 164 aa, Zea mays
  misc_feature: Ceres CLONE ID NO.303105
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 1.80E-76 and BLAST sequence identity of 85.9
MPAGHGLRSRTRDLFARPFRKKGYIPLTTYLRTYKIGDYVDVKVNGAVHKGMPHKFYHGRTGRVWNVTKRAIGVEVNKQVNGRIIRKRIHVRVEHVQPSRCTEEFRLRKAKNDQLKADAKKRGEVISTKRQPLGPKPGFMVEGTTIETVTPIPYDVVNDLKGGY

SEQ ID NO: 408 - DNA, 745 bp, Glycine max
  misc_feature: Ceres CLONE ID no.661086
  misc_feature: Encodes the peptide sequence at SEQ ID NO 409
aaaaaaaagagtgatccttctacactaactaaagccgagcagcgagagagagaaaccctagcaaaaatgccggctggtcacggtttgagatcccgcaccagagattccttctctcgtcccttcaggaagaagggtaccatcgccctcaccacatacctcagaacctaccacgtcggcgattatgtcgacgtcaaggttaacggcgccgtccacaagggaatgcctcacaagttctaccatggccgcaccggtcgcgtctggaatgtcaccaaacgtgctgttggggtcgaagtcaacaagcaggtcggcaacagaatcataaggaagaggattcacgtgcgtgtggagcatgttatgccatcaaggtgcactgaggagttccgccttaggaagatcaagaatgatcagctcaaggctgaggccaaggccaagggtgagaagatcagcaccaagagacagcctcagggtcccaaacctggtttcatggtcgagggggcaacgttggagacagttacccctattccctatgatgtcgtcaatgacctcaagggaggttattagtttcattctcgttgttggtctgcgtagttttttgtttggggattattagtccttttttgtgttggaagagaaacaattcagactattaaaatatttttgttgttttatttgatgttctaaatacatggatatgtttttgtttcgctcgtcataaatgtgctttttctcaaaaaaaaaaaaaaaa

SEQ ID NO: 409 - protein, 164 aa, Glycine max
  misc_feature: Ceres CLONE ID NO.661086
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 4.79E-74 and BLAST sequence identity of 84.7
MPAGHGLRSRTRDSFSRPFRKKGTIALTTYLRTYHVGDYVDVKVNGAVHKGMPHKFYHGRTGRVWNVTKRAVGVEVNKQVGNRIIRKRIHVRVEHVMPSRCTEEFRLRKIKNDQLKAEAKAKGEKISTKRQPQGPKPGFMVEGATLETVTPIPYDVVNDLKGGY

SEQ ID NO: 410 - DNA, 664 bp, Brassica napus
  misc_feature: Ceres CLONE ID no.873612
  misc_feature: Encodes the peptide sequence at SEQ ID NO 411
aagggtttcagccaccaccacacagagaaagagagacagcgaaaatgccggcgggtcacggagtgagggcgagaaccagggatctgttcgcgagagggttcaggaagaagggtgttatcccactctctacctacctcaggaccttcaaagtcggtgattacgtggatgtgaaggtaaatggagccatccacaagggtatgcctcacaagttctaccatggtcgtactggtcgtgtctggaacgttactaagcgagctgttggtgtcgaagtcaacaagcagattggtaacagaatcataaggaagaggttgcatgtgcgtgtggagcacgtgcagcagtcaaggtgtgctgaggagtttaaactaaggaagaagaataacgatgtgctcaaggctgcagccaaagccagaggggagacaatcagcaccaagagacagcctaaaggtcccaagcctggtttcatggtcgagggtatgacattggagactgtcactcccatcccttacgatgttgtcaacgatctcaagggtggctattaagtttttcattttttttcttctatctgcccaagagtctttgcattttgttttttctttytgaatcaagactgctttttatattgtattaagtgatcgtttttcataatcatttgcttattgcgtcc

SEQ ID NO: 411 - protein, 164 aa, Brassica napus
  misc_feature: Ceres CLONE ID NO.873612
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 8.89E-82 and BLAST sequence identity of 95.7
MPAGHGVRARTRDLFARGFRKKGVIPLSTYLRTFKVGDYVDVKVNGAIHKGMPHKFYHGRTGRVWNVTKRAVGVEVNKQIGNRIIRKRLHVRVEHVQQSRCAEEFKLRKKNNDVLKAAAKARGETISTKRQPKGPKPGFMVEGMTLETVTPIPYDVVNDLKGGY

SEQ ID NO: 412 - DNA, 773 bp, Triticum aestivum
  misc_feature: Ceres CLONE ID no.1047389
  misc_feature: Encodes the peptide sequence at SEQ ID NO 413
agcgccgcacacactccccccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaagggtggttactagagcgcttgtttcctgagcagaagcttgagccagttcttagtatctatgcttgttcccaatgttttggtactgagtagttctctttttgctccgccgagtgtgaacttctctgtggttaacattaaagatttcctgtggttgatttcgttcttgacatgctgctggatatatttgcttttaaaaaaaaaaaaaaaa

SEQ ID NO: 413 - protein, 164 aa, Triticum aestivum
  misc_feature: Ceres CLONE ID NO.1047389
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 3.29E-75 and BLAST sequence identity of 84.7
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLKGGY

SEQ ID NO: 414 - DNA, 710 bp, Glycine max
  misc_feature: Ceres CLONE ID no.1074340
  misc_feature: Encodes the peptide sequence at SEQ ID NO 415
ggcgattttaggtttttagtttcgcagtaacccaagaggagaaaaaatgccggcgggacatggagttcgtgctaggacaagagatctgttcgcgagggggttcaggaagaagggtacaattccattgtctacctacctcaggaccttcaaggtcggagattacgtggatgttaaagtgaatggtgcgatccacaagggtatgcctcacaagttctaccacggtcgtaccggtcgtgtctggaacgttaccaaacgtgctgttggtgtcgaagtcaacaaacagattggcaacaggatcataaagaagaggcttcatgtgcgtgtggagcacgtgcagcagtcgaggtgcgctgaggagttcaagctgaggattaagaagaacgatgagctcaaggctgcagccaaggccaaaggcgagacaataagcaccaagaggcagcctaaaggacccaaaccagggtttatggttgaaggtatgaccttggagactgtcaccccaatcccttacgacgtcgtcaacgatctcaagggaggctattagtttttctacttctactttctacccccagtgttttgctcagactttttggcagtttcttttgcgaattctcgagtgttcttcgtgcgttttcgctacagttacattttctttaaggttcaatccagacataatgaaacaaaagttgcaatctccaaaaaaaaaaaaaaaa

SEQ ID NO: 415 - protein, 164 aa, Glycine max
  misc_feature: Ceres CLONE ID NO.1074340
  misc_feature (1)..(164): Functional Homolog of  Ceres CLONE NO.251923 at SEQ ID NO.401 with e-value of 1.19E-79 and BLAST sequence identity of 93.2
MPAGHGVRARTRDLFARGFRKKGTIPLSTYLRTFKVGDYVDVKVNGAIHKGMPHKFYHGRTGRVWNVTKRAVGVEVNKQIGNRIIKKRLHVRVEHVQQSRCAEEFKLRIKKNDELKAAAKAKGETISTKRQPKGPKPGFMVEGMTLETVTPIPYDVVNDLKGGY

SEQ ID NO: 416 - DNA, 532 bp, Zea mays
  misc_feature: Ceres CLONE ID no.1375955
  misc_feature: Encodes the peptide sequence at SEQ ID NO 417
tccaagggtttcagccaccaccacacagagaaagagagacagcgaaaatgccggcgggtcacggagtgagggcgagaaccagggatctgttcgcgagagggttcaggaagaagggtgttatcccactctctacctacctcaggaccttcaaagtcggtgattacgtggatgtgaaggtaaatggagccatccacaagggtatgcctcacaagttctaccatggtcgtactggtcgtgtctggaacgttactaagcgagctgttggtgtcgaagtcaacaagcagattggtaacagaatcataaggaagaggttgcatgtgcgtgtggagcacgtgcagcagtcaaggtgtgctgaggagtttaaactaaggaagaagaataacgatgtgctcaaggctgcagccaaagccagaggggagacaatcagcaccaagagacagcctaaaggtcccaagcctggtttcatggtcgagggtatgacattggagactgtcactcccatcccttacgatgttgtcaacgatctcaaggg

SEQ ID NO: 417 - protein, 161 aa, Zea mays
  misc_feature: Ceres CLONE ID NO.1375955
  misc_feature (2)..(100): Pfam Name: Ribosomal_L21e Pfam Description: Ribosomal protein L21e
  misc_feature (1)..(161): Functional Homolog of  Ceres CLONE NO.251923 at SEQ ID NO.401 with e-value of 9.19E-80 and BLAST sequence identity of 95.6
MPAGHGVRARTRDLFARGFRKKGVIPLSTYLRTFKVGDYVDVKVNGAIHKGMPHKFYHGRTGRVWNVTKRAVGVEVNKQIGNRIIRKRLHVRVEHVQQSRCAEEFKLRKKNNDVLKAAAKARGETISTKRQPKGPKPGFMVEGMTLETVTPIPYDVVNDLK

SEQ ID NO: 418 - DNA, 715 bp, Zea mays
  misc_feature: Ceres CLONE ID no.1449006
  misc_feature: Encodes the peptide sequence at SEQ ID NO 419
cttcggcgattttaaagttctgactggtcacatccaccaaagagacaaaaatgccggcaggacatggagttcgtgctcgaactagagatctgttcgctagagggttcaggaagaagggtacaattccactgtccacctacctaaggaccttcaaggtcggcgaatacgtcgatgttaaagtgaatggcgccatacacaagggtatgcctcataagttctaccatggtcgtactggtcgtgtctggaacgttaccaaacgtgccgttggtgtcgaagtcaacaaacagattggaaacaggatcataaagaagaggcttcatgtgcgtgtggagcatgtgcagcagtctagatgcgctgaggagttcaaactgaggataaagaagaacgatgagttgaaagctgcagccaaagccaaaggcgagacaataagcaccaagaggcagcctaaaggacccaaaccaggattcatggttgaaggtatgaccttggagaccgtcacccctatcccctacgacgttgtcaacgacctcaagggaggctattagttcttctctactttctttcctgttcttgctgtgtgttttggaactctgcatttgtagccacttgaactaagaatatgatttatatgagaattttgcaatccagtttgtttttatcatagttcaattttgtttgtcataaccattgattccaaccaaaaaaaaaaaaaaaa

SEQ ID NO: 419 - protein, 164 aa, Zea mays
  misc_feature: Ceres CLONE ID NO.1449006
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 3.10E-79 and BLAST sequence identity of 92.6
MPAGHGVRARTRDLFARGFRKKGTIPLSTYLRTFKVGEYVDVKVNGAIHKGMPHKFYHGRTGRVWNVTKRAVGVEVNKQIGNRIIKKRLHVRVEHVQQSRCAEEFKLRIKKNDELKAAAKAKGETISTKRQPKGPKPGFMVEGMTLETVTPIPYDVVNDLKGGY

SEQ ID NO: 420 - DNA, 684 bp, Zea mays
  misc_feature: Ceres CLONE ID no.1490319
  misc_feature: Encodes the peptide sequence at SEQ ID NO 421
agttcggcggcttctatcagtttcacttgttcgcacgggaaaaaatgccggcaggacatggagttcgtgctagaacaagagatctgttcgcgagggggttcaggaagaagggtacaattccactgtccacctacctaaggaccttcaaggtcggcgaatacgtcgatgtcaaagtgaacggtgcgatacacaagggtatgcctcacaagttctaccacggtcgtactggtcgcgtctggaacgttaccaaacgtgccgttggtgtcgaagtcaacaaacagattggaaacaggatcataaagaagaggcttcatgtgcgtgtggagcacgtgcagcagtctagatgcgcggaagagttcaaactgaggataaggaagaacgatgagctcaaagctgctgctaaagcaagaggcgagacaataagcaccaagaggcagcctaaaggacccaaaccaggattcatggttgaaggtatgaccttggagacagtcactcctatcccctacgacgtcgtcaacgatctcaagggaggctattagttcttttctactttctctcctgttcttgctgtgtgttttggaactctgcatttgtagccacttgaactaaagaatatgatttatatgagaattttttggagtccagattttcattttgtgtggaatgttaaaaaaaaaaaaaaaa

SEQ ID NO: 421 - protein, 164 aa, Zea mays
  misc_feature: Ceres CLONE ID NO.1490319
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 3.10E-79 and BLAST sequence identity of 92.6
MPAGHGVRARTRDLFARGFRKKGTIPLSTYLRTFKVGEYVDVKVNGAIHKGMPHKFYHGRTGRVWNVTKRAVGVEVNKQIGNRIIKKRLHVRVEHVQQSRCAEEFKLRIRKNDELKAAAKARGETISTKRQPKGPKPGFMVEGMTLETVTPIPYDVVNDLKGGY

SEQ ID NO: 422 - DNA, 699 bp, Panicum virgatum
  misc_feature: Ceres CLONE ID no.1781890
  misc_feature: Encodes the peptide sequence at SEQ ID NO 423
ctcgctaaccctagcccccgcctcccacctgctccccgccgccgccgccgccgcaagtaggaccagccaggatgccggccggccacgggctgcgctcgcggacgcgcgacctcttcgcgcgtcccttccgcaagaaggggtacatcccgctcaccacctacctccgcaccttcaagatcggcgactacgtcgacgtcaaggtgaacggcgccgtccacaaggggatgccgcacaagttctaccacggccgcaccggtcgcgtgtggaacgtcactaagcgcgccatcggcgttgagatcaacaagcaggttaatggccgcatcatcaggaagcgtatccatgtccgtgtggagcatgtgcagcagtcccgctgcactgaggagttccgccagaggaaggcaaagaatgaccagctgaaagcagatgccaaggcacgcggtgaggtcatcagcaccaagaggcagccattgggtcccaagcctggcttcatggttgaaggtgctaccatcgagaccgtcacccccatcccatatgatgttgtcaacgatctcaagggcggttactaggttgctcggtctatctagccgcactaccagttctatatctgtattactctagtgggtacaattttgctctgtccgagcagtagtctggtcctattctgtgtgtttctgttgaaagattttccattctaggtgc

SEQ ID NO: 423 - protein, 164 aa, Panicum virgatum
  misc_feature: Ceres CLONE ID NO.1781890
  misc_feature (1)..(164): Functional Homolog of  Ceres CLONE NO.251923 at SEQ ID NO.401 with e-value of 3.19E-77 and BLAST sequence identity of 86.5
MPAGHGLRSRTRDLFARPFRKKGYIPLTTYLRTFKIGDYVDVKVNGAVHKGMPHKFYHGRTGRVWNVTKRAIGVEINKQVNGRIIRKRIHVRVEHVQQSRCTEEFRQRKAKNDQLKADAKARGEVISTKRQPLGPKPGFMVEGATIETVTPIPYDVVNDLKGGY

SEQ ID NO: 424 - protein, 164 aa, Arabidopsis thaliana; identical to SEQ ID NO: 405
  misc_feature: Public GI ID NO.3482935
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 5.80e-83BLAST sequence identity of97.0

SEQ ID NO: 425 - protein, 164 aa, Oryza sativa subsp. japonica
  misc_feature: Public GI ID NO.3885884
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 4.10E-77 and BLAST sequence identity of 86.5
MPADHGLRARTRDLFARPFRKKGYIPLTTYLRTYKIGEHVDVKVNGAVHKGMPHKFYHGRTGRVWNVTKRAIGVEINKQVGNRIIRKRIHVRVEHVQPSRCTEEFRLRKIKNDQLKADAKARGEVISTKRQPQGPKPGFMVEGATLETVTPIPYDVVNDLKGGY

SEQ ID NO: 426 - DNA, 495 bp, Populus balsamifera subsp. trichocarpa
  misc_feature: Ceres ANNOT ID no.1475022
  misc_feature: Encodes the peptide sequence at SEQ ID NO 427
atgccggctggtcacggtctccggtctcgcactagagatctcttcgctcgtccctttagaaagaagggttacattccattgacaacctacctcagaacctataagattggagaccatgtagacgttaaggttaacggcgccgtccacaagggtatgcctcacaagttttaccatggacgtactggcagagtctggaatgtcaccaaacgtgccatcggcgtagaggtcaacaagcaggtgggtaacaggatcatcaggaagaggatccatgtcagagtggaacatttgctaccctcaaggtgcactgaggaattccgtctcaggaagaagaagaatgatcaactaaaggcagaggctaaggccagaggtgaggttatctgcacaaagaggcagccagagggtcctaaacctggtttcatggtggaaggtgctacattggaaactgttactcccattccatatgatgttgttaacgatctcaagggaggttattag

SEQ ID NO: 427 - protein, 164 aa, Populus balsamifera subsp. trichocarpa
  misc_feature: Ceres ANNOT ID NO.1475022
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 6.69E-77 and BLAST sequence identity of 85.9
MPAGHGLRSRTRDLFARPFRKKGYIPLTTYLRTYKIGDHVDVKVNGAVHKGMPHKFYHGRTGRVWNVTKRAIGVEVNKQVGNRIIRKRIHVRVEHLLPSRCTEEFRLRKKKNDQLKAEAKARGEVICTKRQPEGPKPGFMVEGATLETVTPIPYDVVNDLKGGY

SEQ ID NO: 428 - DNA, 686 bp, Glycine max
  misc_feature: Ceres CLONE ID no.511820
  misc_feature: Encodes the peptide sequence at SEQ ID NO 429
ggcaaaccctagtgcttcccaccgatccatttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccgtcccgctgcacagaagagttccgcctgaggaaggtgaagaatgatcagctgaaggcggatgcaaaggagcgcggcgaggtcatcagcaccaagaggcagccgttgggtcccaagcctggcttcatggttgaggggactaccatcgagaccgtcactcccatcccgtacgatgtggtcaatgatcttaagggcggatactaggttgtttgtttggtctttctacctgttctacatctgtgttactctagtgcgtacaattttgctcacactgagcagtagtatgaacctattgtgtgttcatgttgaaaaaaaaaaaaaaaaaa

SEQ ID NO: 429 - protein, 164 aa, Glycine max
  misc_feature: Ceres CLONE ID NO.511820
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 2.90E-76 and BLAST sequence identity of 85.3
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKVKNDQLKADAKERGEVISTKRQPLGPKPGFMVEGTTIETVTPIPYDVVNDLKGGY

SEQ ID NO: 430 - DNA, 261 bp, Triticum aestivum
  misc_feature: Ceres CLONE ID no.1316006
  misc_feature (204)..(204): n is a, c, t, g, unknown, or other
  misc_feature (212)..(212): n is a, c, t, g, unknown, or other
  misc_feature: Encodes the peptide sequence at SEQ ID NO 431
ctagcgccgcacacactccccccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgncgacgtcnaggtgaacggcgccgtccacaagggcatgccgcacaagttctaccacgg

SEQ ID NO: 431 - protein, 164 aa, Triticum aestivum; identical to SEQ ID NO: 413
  misc_feature: Ceres CLONE ID NO.1316006
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 1.90e-75 and BLAST sequence identity of 84.8

SEQ ID NO: 432 - DNA, 677 bp, Zea mays
  misc_feature: Ceres CLONE ID no.1445194
  misc_feature: Encodes the peptide sequence at SEQ ID NO 433
ggcgatttttaggtttctacttgtcgcatccaccaaagaggaaaaatgccggcgggtcatggagttcgcgctaggacgagggatctgttcgcgagggggttcaggaagaagggtacaatcccactgtcgacttacctcaggaccttcaaggtcggcgattacgtggatgtcaaggtgaacggtgcgatccacaagggtatgcctcacaagttctaccacggtcgtaccggtcgtgtctggaacgtcaccaagcgagccgtcggtgtcgaagtcaacaaacagattggaaacaggatcattaggaagaggcttcatgtgcgtgtggagcacgtgcagcaatccaggtgtgcagaggagttcaagctgaggattaagaagaatgatgagctcaaggccgcagccaaagccagaggtgagacaataagcaccaagagacagcctaaaggccccaagccaggattcatggttgagggtatgaccttggagactgtcaccccaatcccctacgacgtcgtcaacgatctcaagggaggctattagttctactttcttccctcccagcgttttggagctttctttcatatggtttgtagcgacttaatactactggaagatgattttaaacagcatgagttttgttattgataccattgtgtctgccaaaaaaaaaaaaaaaa

SEQ ID NO: 433 - protein, 164 aa, Zea mays
  misc_feature: Ceres CLONE ID NO.1445194
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401 with e-value of 2.70E-80 and BLAST sequence identity of 94.5
MPAGHGVRARTRDLFARGFRKKGTIPLSTYLRTFKVGDYVDVKVNGAIHKGMPHKFYHGRTGRVWNVTKRAVGVEVNKQIGNRIIRKRLHVRVEHVQQSRCAEEFKLRIKKNDELKAAAKARGETISTKRQPKGPKPGFMVEGMTLETVTPIPYDVVNDLKGGY

SEQ ID NO: 434 - protein, 164 aa, Oryza sativa subsp. japonica
  misc_feature: Public GI ID NO.31432571
  misc_feature (2)..(100): Pfam Name: Ribosomal_L21e Pfam Description: Ribosomal protein L21e
  misc_feature (1)..(164): Functional Homolog of  Ceres CLONE NO.251923 at SEQ ID NO.401
MPAGHGLRARTRDLFARPFRKKGYIPLTTYLRTYKIGEHVDVKVNGAVHKGMPHKFYHGRTGRVWNVTKRAIGVEINKQVGNRIIRKRIHVRVEHVQPSRCTEEFRLRKIKNDQLKADAKARGEVISTKRQPQGPKPGFMVEGATLETVTPIPYDVVNDLKGGY

SEQ ID NO: 435 - DNA, 1648 bp, Arabidopsis thaliana
  misc_feature: Ceres CLONE ID no.149496
  misc_feature: Ceres LOCUS ID At1g04990
  misc_feature: Encodes the peptide sequence at SEQ ID NO 436
aattctctgtctgtgataaaagaaaaattgaatttttttcttctatctatctacctctgttcttcctcgtcatttcttacccagaaaaatagaggataacaaaaatctgtttctttcgatgatcatcgtgacactttctctgtgatttttcctttcttctgttgttgttgatcatcgtgatcatcgtctttccttacatgcgaacccccatgtcagacactcagcatgtacagagctctttggtgtcgattcgatcttccgacaaaatcgaagatgcctttaggaagatgaaagtaaatgagaccggcgtggaggaactgaatccgtatccagatcgtcccggtgaaagagattgccaattctatttaagaactggtctctgtggctatggaagcagttgccgttacaatcatcctactcatcttccacaggatgttgcttattacaaggaggagctccctgagagaattggacagccggattgtgagtattttctgaagacaggagcttgtaagtacggcccaacttgtaaatatcatcatccaaaggacaggaacggtgcacaacctgtaatgttcaatgttatcggtttacctatgcgtctgggtgagaagccatgtccatattacctgcgaacgggaacttgcagattcggagttgcttgcaaattccaccatcctcaacctgataatggacattctactgcatatggaatgtctagctttcctgctgcagatttacgatatgctagtggtttaacaatgatgtctacatatggaactttgcctcgtccgcaagttccccagtcctatgtgccaatcctggtttcaccctctcaaggctttttacctcctcaaggctgggccccttacatggctgcatctaactccatgtacaatgtgaagaatcaaccttattactccggtagtagtgcatccatggccatggctgtggcattgaaccgtggtttgtcagaaagttctgaccaaccagaatgtcggttttttatgaacaccgggacatgtaaatacggagacgattgcaaatacagccatcccggagtaaggatttcacaaccaccaccaagtcttataaaccctttagttcttccagcgagacctggacaaccagcttgtggtaacttcaggtcttatggattctgcaagtttggaccaaactgcaaattcgaccaccctatgctgccatatccgggcctgaccatggctacttctctgcctactccttttgcttcacctgttacaacccatcagaggatctcaccaacaccaaaccgctctgattcaaagtctctttctaatggtaaacctgatgtgaagaaagaaagctcagagactgagaaaccagacaatggagaagtgcaggatttgtctgaggatgcgtcatcaccatgatcatgattcttaaaaaccccaatgatctctctctgcccttttttgtggaagaggaggggaggtgaaaagtgtttctcttttctttttttttcttttttttttggcttggagatggccatggctgaaaacaatataggatgaaaccagtgatgttgtcacaggtttctcttctgtttttgactctgttaataaattttaatcagacttatcagaggaaaaatagagtttgtgttgtg

SEQ ID NO: 436 - protein, 404 aa, Arabidopsis thaliana
  misc_feature: Ceres CLONE ID NO.149496
  misc_feature: Ceres LOCUS ID At1g04990
  misc_feature (136)..(162): Pfam Name: zf-CCCH Pfam Description: Zinc finger C-x8-C-x5-C-x3-H type (and similar)
MRTPMSDTQHVQSSLVSIRSSDKIEDAFRKMKVNETGVEELNPYPDRPGERDCQFYLRTGLCGYGSSCRYNHPTHLPQDVAYYKEELPERIGQPDCEYFLKTGACKYGPTCKYHHPKDRNGAQPVMFNVIGLPMRLGEKPCPYYLRTGTCRFGVACKFHHPQPDNGHSTAYGMSSFPAADLRYASGLTMMSTYGTLPRPQVPQSYVPILVSPSQGFLPPQGWAPYMAASNSMYNVKNQPYYSGSSASMAMAVALNRGLSESSDQPECRFFMNTGTCKYGDDCKYSHPGVRISQPPPSLINPLVLPARPGQPACGNFRSYGFCKFGPNCKFDHPMLPYPGLTMATSLPTPFASPVTTHQRISPTPNRSDSKSLSNGKPDVKKESSETEKPDNGEVQDLSEDASSP

SEQ ID NO: 437 - DNA, 1694 bp, Triticum aestivum
  misc_feature: Ceres CLONE ID no.833872
  misc_feature: Encodes the peptide sequence at SEQ ID NO 438
cccctctctccctctgtatcctgcacacaccgccaccgatcactcgccggagcccctcccccaatggccgccgccgccgccgcgatcgcgtgatggccgacccagccgctcgccgaagatggacgaagccggaagggcctccgctcccgcggtggtgacggtcacggcctccgccgccgccccctcgcctcctcctcccccgccccccgccacggccaccgccgcggccgccgacccgccatcgcccgacccggacgctctctatgaagagggaatgtggcagcagatggccatgagcagcggcgccactatgcaatctgggccatatcctgtgcggccaggggaaccggactgcacctactacctcaggactggattgtgcaggttcggcatgagctgcaggttcaatcaccctcaggacaggaatacggctattgcctctgccagaatgaaaggagaatatcctgagagggtgggacaacctgaatgtcagtactatctgaagactggaacatgcaagtttgggcctacgtgcaaattccatcaccctagagaaaaggctggaatcgcaggaatggtgcagctaaacacattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacataactctggaagcaccggtccacattcctatactggaacaatggcaagctggacttatccaagaggttctttcattccaagccctagatggcaaagtccttcaaactatacaccgatgattgtaccacagggtcttgttcaagtaccaaactggaactcatatcctggccaaatggtacctgtttcatctcctgagagtcgactacagtctccaggggctcaacaatactatggaacttctcgacaaggtgaagccagtgcaggaaatcagggaatgcaatcaccctacagatccagttcgtttcctgcacctcagtatgcactgcagagagagaatgtatttcctgagagacctgatcagccagaatgcatatactacataaagactggagattgtaaatttggtgcggtttgcaaattccatcatccccgggtgcgctcacagcctcccccagactgtatcttgagcccaatgggtcttccattacgcccaggcgaagagctctgcaagttctactctcgctatggcatctgcaagttcggcgtaaactgcaagttcgaccatccaatggcggctccgatgggggtctacgcgtacggctactctgcctcggcgtcgcccaacgcgcccatgggtcggcgtctcctggagtccccctccgggtctgcgtacgcctcctaaggcaaggctccctggcatttgaccctaccttgattgatctcgatgatgtataaaagccatcgcgagctgtcgtccctccctcgggcgcgccccgcgaatgttctcccccctaactccccggaatcaagttctgtaaaaatcgagtttgctaccagagatgtacagttgttatttttgttaatgcgggtcagtgtttggatggatggagaagccatttgctaccgaatgaaataatgcttgaatgcagtgttgaaaaaaaaaaaaaaaa

SEQ ID NO: 438 - protein, 435 aa, Triticum aestivum
  misc_feature: Ceres CLONE ID NO.833872
  misc_feature (373)..(399): Pfam Name: zf-CCCH Pfam Description: Zinc finger C-x8-C-x5-C-x3-H type (and similar)
  misc_feature (1)..(435): Functional Homolog of  Ceres CLONE NO.149496 at SEQ ID NO.436 with e-value of 6.30E-65 and BLAST sequence identity of 47.2
MDEAGRASAPAVVTVTASAAAPSPPPPPPPATATAAAADPPSPDPDALYEEGMWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPNWNSYPGQMVPVSSPESRLQSPGAQQYYGTSRQGEASAGNQGMQSPYRSSSFPAPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMGRRLLESPSGSAYAS

SEQ ID NO: 439 - protein, 249 aa, Pisum sativum
  misc_feature: Public GI ID NO.5616313
  misc_feature (27)..(77): Pfam Name: SRF-TF Pfam Description: SRF-type transcription factor
  misc_feature (93)..(192): Pfam Name: K-box Pfam Description: K-box region
  misc_feature (1)..(249): Functional Homolog of  Ceres CLONE NO.149496 at SEQ ID NO.436 with e-value of 1.00e-69 and BLAST sequence identity of 47.4
MAYENKPNTDLDADAQRRLGRGKIEIKRIENTTNRQVTFCKRRNGLLKKAYELSVLCDAEVALIVFSNRGRLYEYSNNSSVRETIERYKKACADTSTNGSASEATTQYYQQEAAKLHNQINALQNINRGYMAEGLSNKNIKELKGMERKLERAITRIRSKKNELLFAEIEYMQKRELDLHNNNQLLRAKIAENERQQQSIIAITGGHGSYEIVQPTQPFHEARNYFQVNALQPNIHQYSCHDQVSLQLV

SEQ ID NO: 440 - protein, 494 aa, Oryza sativa
  misc_feature: Public GI ID NO.77550853
  misc_feature (406)..(432): Pfam Name: zf-CCCH Pfam Description: Zinc finger C-x8-C-x5-C-x3-H type (and similar)
  misc_feature (1)..(494): Functional Homolog of  Ceres CLONE NO.149496 at SEQ ID NO.436 with e-value of 1.00e-60and BLAST sequence identity of 42.4
MAAAPSAGGVGEGSSSSAAAAAAAAAATIGPHVVDEGALCFGHSHNADMFYNVDTLSVIDGMVVITTQNFELQYIKGLWRIWQATPLMGRISFGAAREGLSAAATAVAVAASVIGPHSSDEEAMWQMNLGEAMEAGPYPERIGEPDCSYYMRTGLCRFGMTCKFNHPADRKMAVAAARMKGEYPQRIGQPECQYYLKTGTCKFGATCKFHHPREKAAIATRVQLNALGYPLRPNEKECAYYLRTGQCKFGSTWAVTNWPLSRSASFIASPRWPGHSSYAQVIVPPGLVQVPGWNPYAAQIGSSSSDDQQRTAGGAQYYTGSRHSETPNMGDQGMFSSYQAGSVPLGLYTVQRESIFPERPDQPECQFYMKTGDCKFGAVCKFHHPKERIIPTPNCALSSLGLPLRPGEPICTFYSRYGICKFGPNCKFDHPMGTVMYGLATSPTGDVSARRMLAPVPAHSEVSPDNVSGRSRRITHSDSQQIPSGERGTEREAS

SEQ ID NO: 441 - protein, 428 aa, Medicago truncatula
  misc_feature: Public GI ID NO.124359159
  misc_feature (1)..(428): Functional Homolog of  Ceres CLONE NO.149496 at SEQ ID NO.436
MEYDAIPQEAMWQMSLRPSETMESGPYPEHPGEPDCSYYIRTGLCRFGATCRFNHPPNRKLAIATARMKGEFPERLGQPECQASVNECCIMHYYLKTGTCKFGATCRFHHPKDKAGVAGRVALNILGYPLRPNESECAYYLRTGQCKFGNTCKFHHPQPSNMVLPMRGSPVYPTVQSPTTAGQQSYAAGITNWSTSSYIPSPRWQGPSSYAPLILPQGVVSVPGWSTYNGQMGSDSPQQTMRNDQTYGTSHQGDPENAGLQGVYSQYRSGSVPVGFYALQRENIFPERPDQPECQFYMKTGDCKFGAVCRFHHPRERTIPAPDCVLSPLGLPLRPGEPLCVFYSRYGICKFGPSCKFDHPMGIFTYNVSASPLAEAAGRRLLGSSSGTAALSLSSEGLVESGSVKPRRLSLSETRPNPSGDDDIDDEG

SEQ ID NO: 442 - DNA, 1230 bp, Populus balsamifera subsp. trichocarpa
  misc_feature: Ceres ANNOT ID no.1525459
  misc_feature: Encodes the peptide sequence at SEQ ID NO 443
atgccagaccacaacaacaggcaggttaagagcaatgctgtgtcaaatcaatccgctgaaaacattgaagaagcaatttggcgattgaaaatacatgatcatcaagagcaagggggtatggctcaatcaagtccatacccagatcgtcctggtgcaccagattgtggatattatttaaggactggattatgtggttatggaagcaattgtcgctttaatcatcctgtttatgctgcactgggcgcgcaattgagagaagaacttccagagagagttggacagcctgactgtgggtattatttgaagacagggacttgcaaatatggatctacttgtaaatatcatcatccaagagacaggaatggtgcaggaccagtttcatttaacgcgttgggtcttcctatgcgtcaggatgaaaaatcatgtccttactacatgcggaccagatcatgtaaatttggagttgcatgcaaattccaccacccccagcctgcgtcattgggaactagcttctccctaactggagctgctgcctttggatctacgggatcaccaattgtgccatcttcaggcctgccttatgtaggtggacttccaacatggtcgttaccaagggcaccacttatgtctggcacaaatttacaaggtccacaagcttatatgcctgttgttgtatctccttctccaggcatcattcctgtcccaggctggaacacctatgtgatcagccctattctccctgagagacctggtcaaccagaatgccggcattttatgagcactgggacctgcaaatatggttctgactgcaagtaccatcacccaaaagaaaggattgcacagctagcaaccaatactatgggcctgcttggacttccctcgagacctgggcaagccgtgtgtccagactacagtatgtatggaatctgcaagttcggcccaacctgcagatatgatcaccccatacatacatatccttataactatagcttgagcctgccatctttatctataatggattcatctctgataacttatccaagaatggcacaagcagctcctgttaccttgtcgaaactccctgatttgatccacaatcctgatggtgcaagctacaataagcatcagaatcctgatacaagtacaaagatttcagatgatccaaccgagcaagctggttccccaccaccacactcttcacaggcttcttcagaaccttcacacgattaa

SEQ ID NO: 443 - protein, 409 aa, Populus balsamifera subsp. trichocarpa
  misc_feature: Ceres ANNOT ID NO.1525459
  misc_feature (250)..(276): Pfam Name: zf-CCCH Pfam Description: Zinc finger C-x8-C-x5-C-x3-H type (and similar)
  misc_feature (1)..(409): Functional Homolog of  Ceres CLONE NO.149496 at SEQ ID NO.436 with e-value of 1.39E-85 and BLAST sequence identity of 52.4
MPDHNNRQVKSNAVSNQSAENIEEAIWRLKIHDHQEQGGMAQSSPYPDRPGAPDCGYYLRTGLCGYGSNCRFNHPVYAALGAQLREELPERVGQPDCGYYLKTGTCKYGSTCKYHHPRDRNGAGPVSFNALGLPMRQDEKSCPYYMRTRSCKFGVACKFHHPQPASLGTSFSLTGAAAFGSTGSPIVPSSGLPYVGGLPTWSLPRAPLMSGTNLQGPQAYMPVVVSPSPGIIPVPGWNTYVISPILPERPGQPECRHFMSTGTCKYGSDCKYHHPKERIAQLATNTMGLLGLPSRPGQAVCPDYSMYGICKFGPTCRYDHPIHTYPYNYSLSLPSLSIMDSSLITYPRMAQAAPVTLSKLPDLIHNPDGASYNKHQNPDTSTKISDDPTEQAGSPPPHSSQASSEPSHD

SEQ ID NO: 444 - DNA, 1597 bp, Zea mays
  misc_feature: Ceres CLONE ID no.367249
  misc_feature: Encodes the peptide sequence at SEQ ID NO 445
gttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcctacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaatttctcctggccatcatgcttactagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctcttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgaaaaaaaaaaaaaaaaaa

SEQ ID NO: 445 - protein, 443 aa, Zea mays
  misc_feature: Ceres CLONE ID NO.367249
  misc_feature (308)..(334): Pfam Name: zf-CCCH Pfam Description: Zinc finger C-x8-C-x5-C-x3-H type (and similar)
  misc_feature (1)..(443): Functional Homolog of  Ceres CLONE NO.149496 at SEQ ID NO.436 with e-value of 3.10e-68 and BLAST sequence identity of 43.6
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 446 - DNA, 2020 bp, Zea mays
  misc_feature: Ceres CLONE ID no.1579587
  misc_feature: Encodes the peptide sequence at SEQ ID NO 447
aggttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcccacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaacttctcctggccatcatgcttaccagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgagaatccgaagctgtacaggtcttttgcctcatctttgagctttacataccggagcttgcttcaacatgtattgcatccaggcatgaaaaagttcttgccggttcgggatgctcatttgcccccataaaaacgggaacaaacctaccttatttaaacatatgtatgaaactcactcacctctggacattcaaacccattcgagtaatggtcccggtgttgtagtttatagagctgtgtttcagtggacaaacctttgcgaaactgactggggatgcgcaagcatagcctcctttattaattattatctcgtttttttcctagcatctctcttttcataagggcaacccaaagtgttggaataatagattgccaccataatgctctgtattacccaccatatttaaacctggttacttgtgagcaaaaaaaaaaaaaaaa

SEQ ID NO: 447 - protein, 443 aa, Zea mays; identical to SEQ ID NO: 445
  misc_feature: Ceres CLONE ID NO.1579587
  misc_feature (308)..(334): Pfam Name: zf-CCCH Pfam Description: Zinc finger C-x8-C-x5-C-x3-H type (and similar)
  misc_feature (1)..(443): Functional Homolog of  Ceres CLONE NO.149496 at SEQ ID NO.436 with e-value of 4.19E-68 and BLAST sequence identity of 43.6

SEQ ID NO: 448 - protein, 454 aa, Oryza sativa subsp. japonica
  misc_feature: Public GI ID NO.77554746
  misc_feature (319)..(345): Pfam Name: zf-CCCH Pfam Description: Zinc finger C-x8-C-x5-C-x3-H type (and similar)
  misc_feature (1)..(454): Functional Homolog of  Ceres CLONE NO.149496 at SEQ ID NO.436 with e-value of 3.60e-67 and BLAST sequence identity of 46.1
MAAGAGAGGGGGEGDSNGGGTSPGGVSAAAPAIGPHHLGVAAAEEAMWQMTLGGGESMESTPYPERIGEPDCSYYMRTGLCRFGMTCKFNHPPNRKLAVAAARMNGEYPYRVGQPECQYYLKTGTCKFGATCKFHHPREKAALANRVQLNVLGYPMRPNEKECAYYLRTGQCKFASTCKFHHPQPSNTMVAVRNSMYSPGQSATSPGQHTYPGAVTNWTLSRSASFIASPRWPGHSGYAQVIVPQGLVQVPGWNPYAAQMGSSSPDDQQRTPVTTQYYGSRQSETGGMGDHGMYQSYQGGSVPVGVYTVQGENIFPERPDQPECQFYMKTGDCKFGAVCKFHHPKERLVPAPNCALNSLGLPLRPGEPVCTFYSRYGICKFGPNCKFDHPMGTLMYGSATSPRGDVSSMHYQLSPSPGHPGILLDGGSGRSHRVPQSDSQQIPSGDGNAEREAS

SEQ ID NO: 449 - DNA, 1558 bp, Arabidopsis thaliana
  misc_feature: Ceres CLONE ID no.21240
  misc_feature: Encodes the peptide sequence at SEQ ID NO 450
aaaaccaaaacgatggcgtttcatcacaatcatctctcacaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctctctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttggattatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgttc

SEQ ID NO: 450 - protein, 431 aa, Arabidopsis thaliana
  misc_feature: Ceres CLONE ID NO.21240
  misc_feature (157)..(201): Pfam Name: KNOX1 Pfam Description: KNOX1 domain
  misc_feature (213)..(268): Pfam Name: KNOX2 Pfam Description: KNOX2 domain
  misc_feature (322)..(343): Pfam Name: ELK Pfam Description: ELK domain
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSLSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 451 - DNA, 1446 bp, Populus balsamifera subsp. trichocarpa
  misc_feature: Ceres ANNOT ID no.1508832
  misc_feature: Encodes the peptide sequence at SEQ ID NO 452
atggcctttcaccataacttgccatcacaagaccttcctcttcaccacttcacagaccaacaagcaacagaaaacaccacagcaccaccgaattggctgaacactgctctcctccgctctcaacaaccaccacaacaacgaactcaccaccacttcactgataacaacaacaccaacaatttcttaaacctccatagcgctaccccttccaccaccgccaccacttctgactccgcttctcataatccaactcaatggctctcccgttcctcctcctccctacttaaccgcaaccacagtaccgtcatcgacgacgtctccgccgctgccgccggtggagaccaccccatcatcgctagtatgtcgcaagaatcgtcagaattgaagagcatgaataagagcgaaggagaaaccatggtggagagtggcggtggtggaggagaggcggtggtgaattggcaaaatgcgaagtgtaaagcggacatattggcgcatcctttgtatgatcaattgttgtctgcccacgtggcgtgtttaaggattgccacgcctgttgatcagttgccgaggattgatgcccaattggctcagtcacaacaagtagtggctaaatactctgctcttggaagtcatcaaggattggttcctgatgacaaagagcttgatcagtttatgacacattactttctgttactttgttccttcaaagaacaattgcaacaacatgttcgagttcatgcaatggaagcggtgatggcttgctgggagatagagcaatccctacaaagtttaacaggagtttctccaggtgaaggtactggtgcaacaatgtccgatgatgatgaagaccaagttgacagtgaggccaatatgtttgatggaagtttggagggtgtagatacaatggggtttggtcccttggtccctacagagagtgagagatctttgatggagcgtgtgaggcaggaattgaagcatgaattaaaacagggttacaaggagaaaattgttgacattagagaggaaattttgcgcaagagaagagcgggaaagcttcctggtgacacaacctcagtcttaaaagcttggtggcaatcacattccaagtggccatatcctaccgaggaagacaaggcgagattggtacaggaaacaggtttgcaattaaagcagataaataattggttcatcaatcaaaggaagaggaactggcacagtaatccttcaacttcaacagtcttaaaaagcaaacgcaaaaggtattttattgttttattaaagcatgtattctcatctaatttaatacctgatgagcttcgaactaactttaatttgaaaagaagtaatgcagcttgcactccagcaagtacattgaacatactacatagcaatggaactgcaaagggtttgacagtggtctacagaattcgagtaagagaaccatag

SEQ ID NO: 452 - protein, 481 aa, Populus balsamifera subsp. trichocarpa
  misc_feature: Ceres ANNOT ID NO.1508832
  misc_feature (156)..(200): Pfam Name: KNOX1 Pfam Description: KNOX1 domain
  misc_feature (211)..(266): Pfam Name: KNOX2 Pfam Description: KNOX2 domain
  misc_feature (323)..(344): Pfam Name: ELK Pfam Description: ELK domain
  misc_feature (1)..(481): Functional Homolog of  Ceres CLONE NO.21240 at SEQ ID NO.450 with e-value of 7.39E-149 and BLAST sequence identity of 79.1
MAFHHNLPSQDLPLHHFTDQQATENTTAPPNWLNTALLRSQQPPQQRTHHHFTDNNNTNNFLNLHSATPSTTATTSDSASHNPTQWLSRSSSSLLNRNHSTVIDDVSAAAAGGDHPIIASMSQESSELKSMNKSEGETMVESGGGGGEAVVNWQNAKCKADILAHPLYDQLLSAHVACLRIATPVDQLPRIDAQLAQSQQVVAKYSALGSHQGLVPDDKELDQFMTHYFLLLCSFKEQLQQHVRVHAMEAVMACWEIEQSLQSLTGVSPGEGTGATMSDDDEDQVDSEANMFDGSLEGVDTMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKRYFIVLLKHVFSSNLIPDELRTNFNLKRSNAACTPASTLNILHSNGTAKGLTVVYRIRVREP

SEQ ID NO: 453 - protein, 393 aa, Arabidopsis thaliana
  misc_feature: Public GI ID NO.1045044
  misc_feature (121)..(165): Pfam Name: KNOX1 Pfam Description: KNOX1 domain
  misc_feature (177)..(232): Pfam Name: KNOX2 Pfam Description: KNOX2 domain
  misc_feature (286)..(307): Pfam Name: ELK Pfam Description: ELK domain
  misc_feature (1)..(393): Functional Homolog of  Ceres CLONE NO.21240 at SEQ ID NO.450 with e-value of 4.90E-168 and BLAST sequence identity of 87.9
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 454 - protein, 375 aa, Oryza sativa subsp. japonica
  misc_feature: Public GI ID NO.1805617
  misc_feature (106)..(150): Pfam Name: KNOX1 Pfam Description: KNOX1 domain
  misc_feature (159)..(215): Pfam Name: KNOX2 Pfam Description: KNOX2 domain
  misc_feature (270)..(291): Pfam Name: ELK Pfam Description: ELK domain
  misc_feature (1)..(375): Functional Homolog of  Ceres CLONE NO.21240 at SEQ ID NO.450 with e-value of 1.30E-121 and BLAST sequence identity of 72.4
MAFHGHLPHEMTMQALGADDAAVAAAAAAGGVGAGGAPAWMRYNDGSFLHLQTTSDSSASPSGAAAAAAAAAAAAAAGVQQWMGGGGGGEDAVAAAMGGGGEADAARCKAEILAHPLYEQLLSAHVACLRIATPVDQLPRIDAQLAQSQGVVAKYSALAAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTEEDKARLVQETGLQLKQINNWFINQRKRNWHSNPSSSTSVKTKRKRAGGIHPKQ

SEQ ID NO: 455 - protein, 427 aa, Malus x domestica
  misc_feature: Public GI ID NO.1946222
  misc_feature (165)..(209): Pfam Name: KNOX1 Pfam Description: KNOX1 domain
  misc_feature (218)..(273): Pfam Name: KNOX2 Pfam Description: KNOX2 domain
  misc_feature (330)..(351): Pfam Name: ELK Pfam Description: ELK domain
  misc_feature (1)..(427): Functional Homolog of  Ceres CLONE NO.21240 at SEQ ID NO.450 with e-value of 3.30e-151 and BLAST sequence identity of 75.7
MAYHNHLSQDLPLHHFTDQTHHQHQQYQSDQPDPNSKPPEPHHSFQPAPNWLNSALLRNFTNTDTNPTNSNNANNNGGGVSNFLNLHVTASDSAASQASNQWLSQSHRPILHRNHSDVNDDVTVAGDSMIAAALSHDSADLKPDSILNKNEGGGGDGGVMNWQNARHKAEILAHPLYEPLLSAHVACLRIATPVDQLPRIDAQLAQSQNVVAKYSALGNGMVGDDKELDQFMRNYVLLLCSFKEQLQQHVRVHAMEAVMACWEIEQSLQSLTGVSPGEGTSATMSDDEDDQVDSDANLFDEGMEGHDSMGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKR

SEQ ID NO: 456 - protein, 393 aa, Arabidopsis thaliana
  misc_feature: Public GI ID NO.26451634
  misc_feature (121)..(165): Pfam Name: KNOX1 Pfam Description: KNOX1 domain
  misc_feature (177)..(232): Pfam Name: KNOX2 Pfam Description: KNOX2 domain
  misc_feature (286)..(307): Pfam Name: ELK Pfam Description: ELK domain
  misc_feature (1)..(393): Functional Homolog of  Ceres CLONE NO.21240 at SEQ ID NO.450 with e-value of 9.70e-168 and BLAST sequence identity of 87.7
MAFHNNHFNHFTDQQQHQPPPPPQQQQQQHFQESAPPNWLLRSDNNFLNLHTAASAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 457 - DNA, 1359 bp, Populus balsamifera subsp. trichocarpa
  misc_feature: Ceres ANNOT ID no.1531214
  misc_feature: Encodes the peptide sequence at SEQ ID NO 458
atggcctatcaccataacttgtcatcacaagacctccctcttcaccacttcacagaccaacaagcaacagagaaccacacagcaccaccgaattggctgaacactgccctcctccgctctcaacaaccaccacagcaacaaactcaccaccacttcactgataacaacaacacaaacaatttcttaaacctccacaccgccaccactaccgccaccgccaccacttctgactcaaactctcataacccagttcaatggctctcccggtcctcctcctccctcctaaaccgcaaccacagtgacgtcatcgacgacgtcgccgccggcggggaccacgccatcataactagtatatcgcaagaatcgtcggaattgaagaatatgaataagggtgaaggtgaagccatggatagtggtggaggagagtcggtggtgaattggcaaaatgcaaggtataaagcggacatattgacgcatccgttgtacgatcaattgctgtcggcacacgtggcgtgtttaaggattgccacgccagttgatcagttgccgaggattgatgcacagttggctcagtcacagcaagtagtaactaagtactctgctcttggaagtcaccaaggattggttcctgatgataaagagcttgatcagtttatgacacattattttcttttgctctgttccttcaaagaacaattgcaacaacatgttcgagttcatgcaatggaagcagtgatggcgtgctgggagatagagcaatccctacagagtttaacgggagtttctccaggtgaaggtacaggcgcaacaatgtccgatgacgatgaagaccaagttgacagtgatgccaatttgttcgttggaagtttggagggtgcagatacactggggtttggtcccttggtccctacagagagtgagagatctttgatggagcgtgtgagacaagaattgaagcatgaattaaaacagggttacaaagaaaaaattgttgacattagagaggaaattctgcgaaagagaagagcaggaaagcttcctggggacacaacctcagtcttaaaagcttggtggcaatcacattccaagtggccatatcctaccgaggaagacaaggcaagattggtgcaggaaacgggcttgcaattaaagcagataaataattggttcatcaatcaaaggaagaggaactggcacagtaatccttcaacctcaacagtcttgaaaagcaaacgcaaaagaaaaactctactgagcctgggcaaggaaaaacaaaccctatcgatcaatgcagaagttgaagcaaccagcccccttgaagagggttggtacgcaggagtgactgattccagtcattga

SEQ ID NO: 458 - protein, 452 aa, Populus balsamifera subsp. trichocarpa
  misc_feature: Ceres ANNOT ID NO.1531214
  misc_feature (150)..(194): Pfam Name: KNOX1 Pfam Description: KNOX1 domain
  misc_feature (205)..(260): Pfam Name: KNOX2 Pfam Description: KNOX2 domain
  misc_feature (317)..(338): Pfam Name: ELK Pfam Description: ELK domain
  misc_feature (1)..(452): Functional Homolog of  Ceres CLONE NO.21240 at SEQ ID NO.450 with e-value of 6.50E-150 and BLAST sequence identity of 80.3
MAYHHNLSSQDLPLHHFTDQQATENHTAPPNWLNTALLRSQQPPQQQTHHHFTDNNNTNNFLNLHTATTTATATTSDSNSHNPVQWLSRSSSSLLNRNHSDVIDDVAAGGDHAIITSISQESSELKNMNKGEGEAMDSGGGESVVNWQNARYKADILTHPLYDQLLSAHVACLRIATPVDQLPRIDAQLAQSQQVVTKYSALGSHQGLVPDDKELDQFMTHYFLLLCSFKEQLQQHVRVHAMEAVMACWEIEQSLQSLTGVSPGEGTGATMSDDDEDQVDSDANLFVGSLEGADTLGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKRKTLLSLGKEKQTLSINAEVEATSPLEEGWYAGVTDSSH

SEQ ID NO: 459 - DNA, 1510 bp, Glycine max
  misc_feature: Ceres CLONE ID no.515966
  misc_feature: Encodes the peptide sequence at SEQ ID NO 460
gaacaacaaacaaacaaacaccaccaacaacaaccactcctcttctttttcaccctcgaatccacgcttcctttacaccgcgtttggatctccgttaaacaaaaccattaaaatgtagcgagagaaaaacaaaaccgcaaaagaaaatcagttaatttattaattttatttttttatggctttccacgaccatctccagcacgaaatagcgttccagcgtttcacggaggagcaagagttgaccgagaacagagacatgcagcagaggctcccacctccgacatggctcaacaacgttaacgcgcgtcaacagaatttcctcgacaccgagaagagcgtggatcggaacaaccgaagcgagagcaattgcgaatccgaggatttgagggaatacaaagcggacattctaggtcaccctctctacgatcaactgttgtcggcgcacgtctcgtgcctcagaatcgccacgccggtggaccagcttcctaggatcgatgcgcagcttcagcagtcgcagcgcgtggttgaaaagtactctgcacttgcacacaacggggtcgtcgatgagaaggagcttgatcagttcatgacccattatgttctgttgctctgtgcctttaaagaacaactgcagcagcatgtccgtgttcatgccatggaggcagtgatggcttgttgggatctggagcaatctctgcaaagcttgacaggtgtatctcctggtgaaggaacgggtgcaacaatgtcagacgatgaagatgaccaggcagagagcaatgccaacttatacgaaggaagccttgatggcggcgaaactcttggatttggtcctcttgtccccactgaaagtgaaagatctttgatggaaagagtcaggcatgagttgaagcatgaactaaaacagggttacaaggagaagattgtggacataagagaagaaattctaagaaagagacgagcggggaagcttccaggggacaccacatcccttttgaaagcttggtggcaatcacattctaaatggccttaccccactgaggaagacaaggctagattggtgcaggaaacagggttgcaattaaagcagataaataattggttcataaatcaaaggaaaaggaacytggcatacaaataacccctcatcctctagcaactccaaaagcaaagcgcaagagtagtgcaggagaagccagtaaccagagcttcatgtgaacggtcgcatattttgaacaaaaattattggtattgttctcccttttaatgcatgctcgtgggattcatagatcttacggtccagcgtgaacgtgatggattctggatgaaaaagggaaattcatgatatataaaaccactgtattggttgaattacagaaaattatccctggtattgttgtatatgaggctgctgcatgccgcttgatatctgatattgatgcagtcgcattctattcgatttaatgggtagcatgctgatattattctgcttatttaaaaatattatggatcc

SEQ ID NO: 460 - protein, 345 aa, Glycine max
  misc_feature: Ceres CLONE ID NO.515966
  misc_feature (124)..(179): Pfam Name: KNOX2 Pfam Description: KNOX2 domain
  misc_feature (236)..(257): Pfam Name: ELK Pfam Description: ELK domain
  misc_feature (71)..(115): Pfam Name: KNOX1 Pfam Description: KNOX1 domain
  misc_feature (1)..(345): Functional Homolog of  Ceres CLONE NO.21240 at SEQ ID NO.450 with e-value of 6.10E-125 and BLAST sequence identity of 86.0
MAFHDHLQHEIAFQRFTEEQELTENRDMQQRLPPPTWLNNVNARQQNFLDTEKSVDRNNRSESNCESEDLREYKADILGHPLYDQLLSAHVSCLRIATPVDQLPRIDAQLQQSQRVVEKYSALAHNGVVDEKELDQFMTHYVLLLCAFKEQLQQHVRVHAMEAVMACWDLEQSLQSLTGVSPGEGTGATMSDDEDDQAESNANLYEGSLDGGETLGFGPLVPTESERSLMERVRHELKHELKQGYKEKIVDIREEILRKRRAGKLPGDTTSLLKAWWQSHSKWPYPTEEDKARLVQETGLQLKQINNWFINQRKRNWHTNNPSSSSNSKSKRKSSAGEASNQSFM

SEQ ID NO: 461 - protein, 374 aa, Oryza sativa subsp. japonica
  misc_feature: Public GI ID NO.1805618
  misc_feature (106)..(150): Pfam Name: KNOX1 Pfam Description: KNOX1 domain
  misc_feature (159)..(215): Pfam Name: KNOX2 Pfam Description: KNOX2 domain
  misc_feature (270)..(291): Pfam Name: ELK Pfam Description: ELK domain
  misc_feature (1)..(374): Functional Homolog of  Ceres CLONE NO.21240 at SEQ ID NO.450 with e-value of 8.40E-125 and BLAST sequence identity of 73.2
MAFHGHLPHEMTMQALGADDAAVAAAAAAGGVGAGGAPAWMRYNDGSFLHLQTTSDSSASPSGAAAAAAAAAAAAAAGVQQWMGGGGGGEDAVAAAMGGGGEADAARCKAEILAHPLYEQLLSAHVACLRIATPVDQLPRIDAQLAQSQGVVAKYSALAAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTEEDKARLVQETGLQLKQINNWFINQRKRNWHSNPSSSTSVKTKRKSNAGDNNS

SEQ ID NO: 462 - protein, 426 aa, Lycopersicon esculentum
  misc_feature: Public GI ID NO.6016226
  misc_feature (161)..(205): Pfam Name: KNOX1 Pfam Description: KNOX1 domain
  misc_feature (215)..(270): Pfam Name: KNOX2 Pfam Description: KNOX2 domain
  misc_feature (327)..(348): Pfam Name: ELK Pfam Description: ELK domain
  misc_feature (1)..(426): Functional Homolog of  Ceres CLONE NO.21240 at SEQ ID NO.450 with e-value of 1.19E-127 and BLAST sequence identity of 64.3
MEFQDHFSQEMVLHQQQQQQQQQQNAVLRSMLPESPHHDARKSPPTWLNTSLLRQQHSQFGNASSPSSAAAAAAVAGGNNFLHLQTSNSDSSNSNQWLSPTAAAGGGSNGGGSGHNDELSESMNFAKKMSQQHSGGGEENNNNNNNNNNNNNEEENSWEREKCKADILNHPLYDQLLSAHVSCLRIATPVDQLPRIDAQLAQSQNVVAKYSVLGQGQPPLDDKDLDQFMTHYVLLLSSFKEQLQQHVRVHAMEAVMACWELEQSLQSLTGVAPGEGTGATMSDDDDDQADSDTNFLDGGFDGPDSMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSSSQKSQTQECR

SEQ ID NO: 463 - DNA, 1218 bp, Arabidopsis thaliana
  misc_feature: Ceres CLONE ID no.19080
  misc_feature: Ceres LOCUS ID At5g60850
  misc_feature: Encodes the peptide sequence at SEQ ID NO 464
atgctcaccacttcacctctctctctctttcttctccactgtaacctcccaattcaaaaacaattataaaccaaacttgattaatatatatttctttatcatcatctcttcgaaatgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttgattctgatcatagcttcttcttcttaacccaaaaatatatattttatacacataaggtaaagttcgatgaagtggttttttwaatttttatttgatgggtctaaaacgggatttattatataattatatgactgcttgtaaatttttttcccaaatatcaaatttacctctcttttttttt

SEQ ID NO: 464 - protein, 307 aa, Arabidopsis thaliana
  misc_feature: Ceres CLONE ID NO.19080
  misc_feature: Ceres LOCUS ID At5g60850
  misc_feature (46)..(108): Pfam Name: zf-Dof Pfam Description: Dof domain, zinc finger
MQDIHDFSMNGVGGGGGGGGRFFGGGIGGGGGGDRRMRAHQNNILNHHQSLKCPRCNSLNTKFCYYNNYNLSQPRHFCKNCRRYWTKGGVLRNVPVGGGCRKAKRSKTKQVPSSSSADKPTTTQDDHHVEEKSSTGSHSSSESSSLTASNSTTVAAVSVTAAAEVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVDHAYWSQSQWTSSDQDQSGLYLP

SEQ ID NO: 465 - protein, 336 aa, Arabidopsis thaliana
  misc_feature: Public GI ID NO.5059396
  misc_feature (45)..(107): Pfam Name: zf-Dof Pfam Description: Dof domain, zinc finger
  misc_feature (1)..(336): Functional Homolog of  Ceres CLONE NO.19080 at SEQ ID NO.464 with e-value of 2.20E-140 and BLAST sequence identity of 92.5
MQDIHDFSMNGVGGGGGGGGRFFGGGIGGGGGDRRMRAHQNNILNHHQSLKCPRCNSLNTKFCYYNNYNLSQPRHFCKNCRRYWTKGGVLRNVPVGGRSRKAKRSKTKQVPSSSSADKPTTTQDDHHVEEKSSTGSHSSSETLLSPLLTLPPSPPSPSPRRQVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVIMHTGVKVNGRRLTKIRVVSTFLDSDHSFFFLTQKYIFYTHKVKFDEVVFLIFI

SEQ ID NO: 466 - DNA, 966 bp, Populus balsamifera subsp. trichocarpa
  misc_feature: Ceres ANNOT ID no.1473196
  misc_feature: Encodes the peptide sequence at SEQ ID NO 467
atgcaagacacccactcaattggtggcggaggcaggttatttagcggtggaggtgggggtgacaggcgactacggccacaccaccaccagaaccaccaagcattaaagtgcccacgatgtgactcgctgaacacgaaattctgttactacaacaactacaacctctctcagcctcgtcacttctgtaagagttgccggcgttactggactaaaggcggtgtcctccgcaacgttcctgttggcggtggatgccgcaagaccaagcggtctaagcttaaacaaaacacaccaagtacaacttctgatgcaattacaacctccagtactagaccgcaggagctacaggaacaacatcagcgacgagatcatatgtcctccaactctcattctagtagtgagagttcgagtcttacggctacaaataacacgaatgcaaatacagcagtggaagcagtgtctgcgctttctgtaaattctgtttccaataatttattaaatggtattgttgagtccaaaatctttccacgtggggatatgaatcccagtttcgaacctgctttgctcgagcaaggatcggactgtgggattttctcggagattgggagtttcacaagcttgatcacatcgacgaacgacttgtcgtttggatttagcaacacaacgaaccaacagcagcaacaagggcttgagcatcatgtgcagaacaatcagaaccagcagcagtggcaaaatcagcatcaggagatgacaggaggagggttgattgatcagacgattcacgctgagttatcagctttgccgagtagtagtagatcaacagagaataccggtgggggatttggagcgttggattggcagttagggagtggagatcaagctggtgggtttttttatcttcctaataccgttgatcaagcttactggagtcagagccaatggaatgatatgactgcttacctcccgtaa

SEQ ID NO: 467 - protein, 321 aa, Populus balsamifera subsp. trichocarpa
  misc_feature: Ceres ANNOT ID NO.1473196
  misc_feature (30)..(92): Pfam Name: zf-Dof Pfam Description: Dof domain, zinc finger
  misc_feature (1)..(321): Functional Homolog of  Ceres CLONE NO.19080 at SEQ ID NO.464 with e-value of 1.39E-60 and BLAST sequence identity of 57.8
MQDTHSIGGGGRLFSGGGGGDRRLRPHHHQNHQALKCPRCDSLNTKFCYYNNYNLSQPRHFCKSCRRYWTKGGVLRNVPVGGGCRKTKRSKLKQNTPSTTSDAITTSSTRPQELQEQHQRRDHMSSNSHSSSESSSLTATNNTNANTAVEAVSALSVNSVSNNLLNGIVESKIFPRGDMNPSFEPALLEQGSDCGIFSEIGSFTSLITSTNDLSFGFSNTTNQQQQQGLEHHVQNNQNQQQWQNQHQEMTGGGLIDQTIHAELSALPSSSRSTENTGGGFGALDWQLGSGDQAGGFFYLPNTVDQAYWSQSQWNDMTAYLP

SEQ ID NO: 468 - DNA, 1594 bp, Glycine max
  misc_feature: Ceres CLONE ID no.1640653
  misc_feature: Encodes the peptide sequence at SEQ ID NO 469
agtccgaagactctttctctcttctctttcacgctattccccgaaaccttgtttccacactgacacacactccttcacccaacaccaacagaacaataaaacatagtacactacacagtgaaaaagagagagaactctctcttctttctttctttctttctttctcagtcacataacacaaaaaacattactaaacttcaggtttcgtttgtggccggaaatgcaggaaatacactccatcggcggcggaaggttcttcggcggcggcggcgaccggaggctgaggccgcaccaccagaaccaccaccagcagccgccgataaaatgcccccgctgcgactcactcaacaccaagttctgctactacaacaactacaacctctcccagccgcgccatttctgcaagaactgccgtcgctactggaccaaaggcggcgtcctccgcaacgtccccgttggcggcggttgccggaaatcaaaacgctccaacaagcccaaaaccaccacctcagccgccgccaccaccagcagcaacaataacaataacaacccttcctcttcctcggaaaccgctgcggcaaccgcaccaacgccaccacaacaaccgcctccgccacttgagctagagcataattctcactctcactccagcagcgaaagctccacttataccgtcgctgccacggaggccatgtcagcgccgacaacgaatgcggtgtcgaacaacaatttattacttgacaacaaccgtgagtcgaagatgttcgctaaccctaacccctatttagagcagagtcgtagtggtggccttttctctgacatagagagcttcagcagcctcgtcaatttaaacaaccaagcattggggtttgggtttgggaacaataatagcaacatcagcatcctcgatgcgacgtcgtttcggtttggtgttagtgttactaatccgcacgggaatgatcaggtgcttgcggcaccaggtggaggccatggtcagtggcaacaacaacagcagaatcatcatgagttcggtacggcgtcgtttcttgatcacaccgtgccgcttgagttttcttcgctgcagcataaagctgggcatcagggagggtttggaccgttggattggcaacccggtggggatcaaggtttgtttgatcttcctaacactgttgatcaaccttactggacacaccacactcattggtctgatcaagataatccttcttctctctttcatcttccctgaaagtactcaagaaatttctctttttttttgttttttatgacctgagaggaaaagcgtaaaagaatatttgtttggagtctaaagcaacgtagaaaaacaaattggaagagaacctggaaggaacttctaattaaaatatgtaaatttctggtttttttacttttctttttttgggggggtgattgggcttgatcataagtagtgatgttctaatgttcatgtgaaactaacatccatgttagttttttttgcttatgttttattttatgtacttattatttggaatttatttactaggggggaaaacataggagcgttttactttttaacaaaaaaaaaaaaaaaaaa

SEQ ID NO: 469 - protein, 341 aa, Glycine max
  misc_feature: Ceres CLONE ID NO.1640653
  misc_feature (29)..(91): Pfam Name: zf-Dof Pfam Description: Dof domain, zinc finger
  misc_feature (1)..(341): Functional Homolog of  Ceres CLONE NO.19080 at SEQ ID NO.464 with e-value of 8.90E-50 and BLAST sequence identity of 54.5
MQEIHSIGGGRFFGGGGDRRLRPHHQNHHQQPPIKCPRCDSLNTKFCYYNNYNLSQPRHFCKNCRRYWTKGGVLRNVPVGGGCRKSKRSNKPKTTTSAAATTSSNNNNNNPSSSSETAAATAPTPPQQPPPPLELEHNSHSHSSSESSTYTVAATEAMSAPTTNAVSNNNLLLDNNRESKMFANPNPYLEQSRSGGLFSDIESFSSLVNLNNQALGFGFGNNNSNISILDATSFRFGVSVTNPHGNDQVLAAPGGGHGQWQQQQQNHHEFGTASFLDHTVPLEFSSLQHKAGHQGGFGPLDWQPGGDQGLFDLPNTVDQPYWTHHTHWSDQDNPSSLFHLP

SEQ ID NO: 470 - protein, 282 aa, Oryza sativa subsp. japonica
  misc_feature: Public GI ID NO.51979356
  misc_feature (40)..(102): Pfam Name: zf-Dof Pfam Description: Dof domain, zinc finger
  misc_feature (1)..(282): Functional Homolog of  Ceres CLONE NO.19080 at SEQ ID NO.464 with e-valuie of 6.80e-33 and BLAST sequence identity of 53.0
MQEFQSIPGLAGRLFGGAAAADIRRAQAQQGPASRCGGIPSPEAVKCPRCESTNTKFCYYNNYNLSQPRHFCKSCRRYWTKGGVLRNVPVGGGCRKTKRSGSSSAASSAPSTPTAATDNAKNQRRASASSPRSSSGGSGNTSPTAAAATTPTTPATPSSNTIAVINHATTTTTTTNPFPTDVPPPAPIFADQAAALASLFAPPPPPPLPVFSFAAQAKTEDGIASVLLAGQTTAPTAATVADMTPFTSLDAGIFELGDVPPAAYWNAGSCWTDVPDPNVYLP

SEQ ID NO: 471 - protein, 291 aa, Triticum aestivum
  misc_feature: Public GI ID NO.67523403
  misc_feature (43)..(105): Pfam Name: zf-Dof Pfam Description: Dof domain, zinc finger
  misc_feature (1)..(291): Functional Homolog of  Ceres CLONE NO.19080 at SEQ ID NO.464 with e-value of 5.10E-31 and BLAST sequence identity of 58.0
MQDFQSIPGLAGRLFGGAAAADIRRVQGPASRCGVFSQAASAQPEAAVKCPRCESTNTKFCYYNNYNLSQPRHFCKSCRRYWTKGGVLRNVPVGGGCRKAKRSSSSASAPSTPAATDAKSQRRASASSSSRSNSGSGSASPTAAAEETTTTETEPPPPPTPSSNSNSNAVSFANRMTNYPFAADVPPLAPIFADQAAALASLFAPPPPPPLPVFSFSAEPKMEEAIGSLLLPGQEASQEPEEPTCTSTVADMAPFMSLDAGIFELGDASPADYWNGGSCWTDVQDPSVYLP

SEQ ID NO: 472 - DNA, 1105 bp, Arabidopsis thaliana
  misc_feature: Ceres CLONE ID no.33231
  misc_feature: Ceres LOCUS ID At5g60660
  misc_feature: Encodes the peptide sequence at SEQ ID NO 473
aacattaaaactcatctctctcatcatctttggccatggcaaaagacttggatgtgaacgagagtggaccaccggcggcgagagactacaaggatccgcctcccgcaccatttttcgacatggaggagcttaggaaatggccgctttatagagcggtcatagctgagtttgtagcaacacttctgttcctctacgtctcaatcctgactgtaatcggctacaaagctcaaaccgatgcaaccgccggaggagtggattgtggcggcgtaggaatattgggtattgcgtgggctttcggtggaatgatctttgttctcgtttactgtaccgccggtatctccggtggtcatataaatccggctgtgacggtgggactattcctggctcgtaaagtgtcattggtgcggacagtgttatacattgtggctcagtgccttggtgccatctgcggttgcggtttcgtcaaagcattccaaagttcttactacaccagatatggaggtggagccaacgagctagccgatggctacaacaaaggtaccggactcggtgccgagatcattggaacttttgtccttgtatacaccgtcttctcggcaaccgatcccaagcgaaatgctcgtgactctcacgtgccagttttggctccacttcccattggctttgccgtcttcatggttcatttagccaccattcccatcaccggaaccggtatcaacccggctcgtagctttggagctgccgttatttacaacaacgaaaaggcctgggacgaccaatggattttttgggttggaccgatgatcggagcagcagcagcagcgttttaccatcagtttattttaagagcggctgcgattaaagctcttggctcatttggctcctttggctcctttaggagctttgcttaatatacatttattttaaattaaaccacaagttataaatctttgatcaaaattaaaaggatgattacaaatgaattaagtggaagttacatgtgatcttctttttatatgtttctgtttttttgttctctctttcatttcatggaatttcccattcgtgtaattgtaaatgtggttttaattaatgttgctttaag

SEQ ID NO: 473 - protein, 291 aa, Arabidopsis thaliana
  misc_feature: Ceres CLONE ID NO.33231
  misc_feature: Ceres LOCUS ID At5g60660
  misc_feature (31)..(266): Pfam Name: MIP Pfam Description: Major intrinsic protein
MAKDLDVNESGPPAARDYKDPPPAPFFDMEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 474 - DNA, 858 bp, Populus balsamifera subsp. trichocarpa
  misc_feature: Ceres ANNOT ID no.1457917
  misc_feature: Encodes the peptide sequence at SEQ ID NO 475
atggcaaaggatactgaagtggcagaggcaggatcattctctgcaaaagattaccaagacccacccccagcaccattgattgatgccgaagagctaacaaagtggtcattttacagggccttgattgctgagtttatagcaactatgctctttctttacatcactgttttgactgttattgggtacaaaagccagattgatggaaatgctgatccttgtggtggggttggtattcttggtattgcttgggcctttggtggcatgatctttgttcttgtttactgcactgctggtatttcagggggtcacattaacccagcagtgacatttgggctgttcttggccaggaaggtgtctttgatcagggctgtgatgtacatggtggcccaatgcgcgggagccatatgtggtgttgggttggtcaaggccttccaaaagtcttactacacaaaatataatggcggagccaacgttttggctgatgggtacagcacaggcactggattgggcgctgagattattgggacttttgtcctggtctacactgtgttctctgctactgatcccaagaggagtgctagggactcccatgtgcctgtattggctcctctcccaattggatttgctgtgttcatggttcacttggccaccatcccaatcacaggaactggcatcaaccctgctaggagttttggagctgctgttatctacaacaacaagaaggcctggcatgaccagtggatcttttgggctggacccttcattggtgcagccatagcagccttctaccaccaattcatcttgagagcaggagctattaaggctctcgggtcattcaggagcaacccgaatgtctaa

SEQ ID NO: 475 - protein, 285 aa, Populus balsamifera subsp. trichocarpa
  misc_feature: Ceres ANNOT ID NO.1457917
  misc_feature (31)..(264): Pfam Name: MIP Pfam Description: Major intrinsic protein
  misc_feature (1)..(285): Functional Homolog of  Ceres CLONE NO.33231 at SEQ ID NO.473 with e-value of 9.70E-124 and BLAST sequence identity of 82.5
MAKDTEVAEAGSFSAKDYQDPPPAPLIDAEELTKWSFYRALIAEFIATMLFLYITVLTVIGYKSQIDGNADPCGGVGILGIAWAFGGMIFVLVYCTAGISGGHINPAVTFGLFLARKVSLIRAVMYMVAQCAGAICGVGLVKAFQKSYYTKYNGGANVLADGYSTGTGLGAEIIGTFVLVYTVFSATDPKRSARDSHVPVLAPLPIGFAVFMVHLATIPITGTGINPARSFGAAVIYNNKKAWHDQWIFWAGPFIGAAIAAFYHQFILRAGAIKALGSFRSNPNV

SEQ ID NO: 476 - DNA, 909 bp, Populus balsamifera subsp. trichocarpa
  misc_feature: Ceres ANNOT ID no.1462053
  misc_feature: Encodes the peptide sequence at SEQ ID NO 477
atggcgaaggatattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctcatgagggtcgtttcctttctgactttgattgtttttctcatctcgggatcttggtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaa

SEQ ID NO: 477 - protein, 302 aa, Populus balsamifera subsp. trichocarpa
  misc_feature: Ceres ANNOT ID NO.1462053
  misc_feature (1)..(302): Functional Homolog of  Ceres CLONE NO.33231 at SEQ ID NO.473 with e-value of 7.80E-122 and BLAST sequence identity of 84.0
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPHEGRFLSDFDCFSHLGILVLAPLPIGFAVFMVHLATIPITGTGINPARSFGAAVIFNQSKAWDDHWLFWVGPFIGAAIAAFYHQFILRAAAIKALGSFRSNA

SEQ ID NO: 478 - DNA, 858 bp, Populus balsamifera subsp. trichocarpa
  misc_feature: Ceres ANNOT ID no.1475405
  misc_feature: Encodes the peptide sequence at SEQ ID NO 479
atgggcaaggacattgaagttggaggcgagttcagtgccaaggactatcatgaccctccgccagcgccattgatcgatgctgaggaaataacccagtggtctttttatcgggctattattgctgagttcgttgccacgctcttgtttctgtacatcactgttttgaccgtgataggttacaagagccagactgacgttaataaaaacggtgatgaatgtggtggggttggcattcttggcatcgcttgggcctttggtggcatgatttttattcttgtttactgcactgctggtatctcaggtggacatattaacccggctgtgactttcggtttgttcttggctaggaaggtctccttggtgcgtgccattctatacatggtggctcagtgcctgggggccatatgtggatgtggacttgtgaaagcattccaaaagtcttattacacaaactatggtggtggagccaatggacttgctaacggatacagcaagggaactgggttaggtgctgagatcattggcacctttgttcttgtctacactgttttctctgctaccgaccccaagaggaatgcaagggattctcatgttcctgtactggcaccacttcccattggatttgctgttttcatggttcacctggccactattccaatcaccggtactggtatcaaccctgctaggagcttcggagctgcagtgatcttcaacaaggaaaaggcatgggatgaccattggattttctgggttggacctttcattggtgctgcaattgctgccttatatcaccagttcatcttgagagcagctgctgttaaatcccttggatccttccggagctctcccaacatataa

SEQ ID NO: 479 - protein, 285 aa, Populus balsamifera subsp. trichocarpa
  misc_feature: Ceres ANNOT ID NO.1475405
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 7.39E-126 and BLAST sequence identity of 82.9
MGKDIEVGGEFSAKDYHDPPPAPLIDAEEITQWSFYRAIIAEFVATLLFLYITVLTVIGYKSQTDVNKNGDECGGVGILGIAWAFGGMIFILVYCTAGISGGHINPAVTFGLFLARKVSLVRAILYMVAQCLGAICGCGLVKAFQKSYYTNYGGGANGLANGYSKGTGLGAEIIGTFVLVYTVFSATDPKRNARDSHVPVLAPLPIGFAVFMVHLATIPITGTGINPARSFGAAVIFNKEKAWDDHWIFWVGPFIGAAIAALYHQFILRAAAVKSLGSFRSSPNI

SEQ ID NO: 480 - DNA, 858 bp, Populus balsamifera subsp. trichocarpa
  misc_feature: Ceres ANNOT ID no.1484924
  misc_feature: Encodes the peptide sequence at SEQ ID NO 481
atgggcaaggacgttgaagttagaggcgaattcattgccaaggactatcatgaccctccaccagcaccattgattgatgccgaggagctcacccagtggtctttgtatagggccatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcctgggggccatatgtggatgtggactcgtgaaagctttccaaaagtcgtattacacaaagtacggtggtggagccaatgaacttgctactggattcagcaagggcactggattaggtgctgagatcatcggtacctttgttctcgtctacactgtcttctctgctactgacccaaagaggaacgcaagggactcccatgttcccgtgttggcaccacttcccatcggatttgctgtcttcatggttcacttggccactattccaatcactggaactggtatcaacccagctaggagctttggagctgctgtgatatacaacaaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaa

SEQ ID NO: 481 - protein, 285 aa, Populus balsamifera subsp. trichocarpa
  misc_feature: Ceres ANNOT ID NO.1484924
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 4.50E-126 and BLAST sequence identity of 83.6
MGKDVEVRGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGANELATGFSKGTGLGAEIIGTFVLVYTVFSATDPKRNARDSHVPVLAPLPIGFAVFMVHLATIPITGTGINPARSFGAAVIYNKDKAWDDHWIFWVGPFIGAAIAALYHQYVLRAAAVKALGSFRSSSNI

SEQ ID NO: 482 - DNA, 858 bp, Populus balsamifera subsp. trichocarpa
  misc_feature: Ceres ANNOT ID no.1484925
  misc_feature: Encodes the peptide sequence at SEQ ID NO 483
atgggcaaggacattgaagttggaggcgaattcagtgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcttgggggccatatgtggatgtggactcgtgaaagctttccaaaagtcgtattacacaaagtacggtggtggagtcaatgaacttgctacaggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacgaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaa

SEQ ID NO: 483 - protein, 285 aa, Populus balsamifera subsp. trichocarpa
  misc_feature: Ceres ANNOT ID NO.1484925
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 5.80E-126 and BLAST sequence identity of 83.2
MGKDIEVGGEFSAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGVNELATGFSKGTGLGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 484 - DNA, 858 bp, Populus balsamifera subsp. trichocarpa
  misc_feature: Ceres ANNOT ID no.1518415
  misc_feature: Encodes the peptide sequence at SEQ ID NO 485
atggcgaaggacatggaagttgcagaggcaggatcattctctgcgaaggactaccatgacccaccaccagcaccattgtttgatgctaaagagttaacaaagtggtcattttacagggccttgattgctgagtttatagcaacactgctctttctttatatcactgttttgactgttattggttacaagagccagattgatggaagtgctgattcttgtggtggggttggtattcttggtattgcctgggcctttggtggcatgatctttgttcttgtatactgcactgctggtatttcagggggtcacattaacccagcagtgacatttgggcttttcctagccaggaaggtctctttgatccgggctgtgatgtacatggtggctcaatgcttaggagccatatgtggcgttgggcttgttaaggccttccaaaagtcttactacaagaagtatggtggtggagccaacactttggccgatgggttcagcaccggcactggattgggtgctgagatcattggcacttttgtcctggtctacactgttttctctgctacagatccaaagaggagtgctagggactcccatgtgcctgttttggctcctcttccaattggatttgctgtgttcatggttcacttggccaccatccccatcactggaactggcatcaaccctgctaggagtctgggagccgctgttatctacaaccaagacaaggcctgggatggccattggatcttctgggttggacccttcgctggtgcagccattgcagctttctaccaccaattcatcttgagagcaggagctgtcaaggctcttggatcattcaggagcgcccaacggttttaa

SEQ ID NO: 485 - protein, 285 aa, Populus balsamifera subsp. trichocarpa
  misc_feature: Ceres ANNOT ID NO.1518415
  misc_feature (31)..(264): Pfam Name: MIP Pfam Description: Major intrinsic protein
  misc_feature (1)..(285): Functional Homolog of  Ceres CLONE NO.33231 at SEQ ID NO.473 with e-value of 6.79E-123 and BLAST sequence identity of 80.7
MAKDMEVAEAGSFSAKDYHDPPPAPLFDAKELTKWSFYRALIAEFIATLLFLYITVLTVIGYKSQIDGSADSCGGVGILGIAWAFGGMIFVLVYCTAGISGGHINPAVTFGLFLARKVSLIRAVMYMVAQCLGAICGVGLVKAFQKSYYKKYGGGANTLADGFSTGTGLGAEIIGTFVLVYTVFSATDPKRSARDSHVPVLAPLPIGFAVFMVHLATIPITGTGINPARSLGAAVIYNQDKAWDGHWIFWVGPFAGAAIAAFYHQFILRAGAVKALGSFRSAQRF

SEQ ID NO: 486 - DNA, 1060 bp, Arabidopsis thaliana
  misc_feature: Ceres CLONE ID no.11998
  misc_feature: Ceres LOCUS ID At2g37180
  misc_feature: Encodes the peptide sequence at SEQ ID NO 487
acaagccctacaacaaccacaaagcaaaacacttacttagaaagtccagaaacatccattaacacatatggctaaagacgtggaaggatctgatggatttcagacgagagattacgaagatcctccgccaacaccgtttttcgacgcagaggagcttaccaagtggtctttatacagagcagtcatcgccgagttcgtagccactctcctcttcttgtacgtcaccgttttaactgtcattggttacaagattcagtccgacacaaaagccggtggagttgactgcggcggcgtcggaatccttggcatcgcgtgggcttttggtggcatgatcttcatccttgtctactgcaccgccggtatctcaggtggtcacataaaccctgcggtgacgtttggtttgttcttagcccggaaggtatcgctgattagggcggtgctttacatggtggctcagtgtttgggtgctatttgtggagttgggtttgtgaaggcatttcaaagctctcactatgttaattacggtggaggagccaactttctagctgacggctacaatacaggcaccggactcgcggcagagatcatcggaacattcgtgcttgtctacacagtcttctccgctactgatcccaaacgcaacgctagagactcccacgttccggttttggcgccacttccgattgggtttgcggtgtttatggtacatttggccactattccgatcaccggaaccggtatcaacccggctaggagtttcggagccgccgtaatctttaacaagagcaagccatgggatgaccactggatattctgggtgggaccattcattggagctacgatagctgcattttatcaccaattcgttctaagggcctcaggctccaagtccctcggttcattcagaagtgcagccaacgtttaaacttagccacgaaagaaaaaaagtgtgcctacaattatgtagaaacatatcctcttttccactcgtatcttagcttcttcctattttctatttctaactgtgtgattccatattaaatcgagtgaaatgtttttc

SEQ ID NO: 487 - protein, 285 aa, Arabidopsis thaliana
  misc_feature: Ceres CLONE ID NO.11998
  misc_feature: Ceres LOCUS ID At2g37180
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 2.49E-125 and BLAST sequence identity of 83.6
MAKDVEGSDGFQTRDYEDPPPTPFFDAEELTKWSLYRAVIAEFVATLLFLYVTVLTVIGYKIQSDTKAGGVDCGGVGILGIAWAFGGMIFILVYCTAGISGGHINPAVTFGLFLARKVSLIRAVLYMVAQCLGAICGVGFVKAFQSSHYVNYGGGANFLADGYNTGTGLAAEIIGTFVLVYTVFSATDPKRNARDSHVPVLAPLPIGFAVFMVHLATIPITGTGINPARSFGAAVIFNKSKPWDDHWIFWVGPFIGATIAAFYHQFVLRASGSKSLGSFRSAANV

SEQ ID NO: 488 - DNA, 1558 bp, Zea mays
  misc_feature: Ceres CLONE ID NO.219143
ggggggatccttggctttacagcacaaacctcgatagcctatccagccagcatcgttggattggagcacgcaaacaaaaccaaaagggagagcgacagcgwcaggaaataatacccaggggaaaaaacagagagagaaagaaaagaaaagaaaagaaaaggccattcaatcttatcaacacaaagttgatttaataaaaaaaggcaggaatcggtacagaagctgctgaattttctgttccattccatcaagcaataatgaagcgggggagcatggcccgccccagccttgcagcactattgtgctttgttgtcacttacctactcttcactccctccataaatagcaccactgcaccctctccttcgcgcactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgccttttttttgtttcagcagctgctgcgttgcgcgcgtgcgtgagatttggtttggtttcgttcccctgcaatgtaatcatgtcgtgactctcaagggattattccgctc

SEQ ID NO: 489 - protein, 290 aa, Zea mays
  misc_feature: Ceres CLONE ID NO.219143
  misc_feature (34)..(271): Pfam Name: MIP Pfam Description: Major intrinsic protein
  misc_feature (1)..(290): Functional Homolog of  Ceres CLONE NO.33231 at SEQ ID NO.473 with e-value of 4.20E-123 and BLAST sequence identity of 83.3
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 490 - DNA, 1282 bp, Zea mays
  misc_feature: Ceres CLONE ID NO.224986
aagcactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccracgcggcgtgcgrcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgcctttttttttgtttcagcagctgctgcgttgcgcgcgtgcgtgagatttggtttggtttcgttcccctgcaatgtaatcatgtcgtgactctcaagggattattccgctctgctcttatggtctctgttttctatttaatgattgttattaccatgtagcagtaaccatcgtcatcagtgagaaccttgttgcttctgtc

SEQ ID NO: 491 - protein, 309 aa, Zea mays
  misc_feature: Ceres CLONE ID NO.224986
  misc_feature (34)..(271): Pfam Name: MIP Pfam Description: Major intrinsic protein
  misc_feature (1)..(309): Functional Homolog of  Ceres CLONE NO.33231 at SEQ ID NO.473 with e-value of 1.30E-121 and BLAST sequence identity of 82.6
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKAPRLLQEQRVMSGAWLWSNGGRPTGGGP

SEQ ID NO: 492 - DNA, 1260 bp, Zea mays
  misc_feature: Ceres CLONE ID no.229381
  misc_feature: Encodes the peptide sequence at SEQ ID NO 493
atctccggcctcacaccgcaaccgcaagcaagcgaagcrcgagcctgcctgaccagagctagctgagtgcaacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggcatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggtccactgattggcgccgccatcgccgccgcctaccaccagtacgtgctgagggccagcgccaccaagctcgggtcctaccggagcaacgcctaagttccgcccggacgcgccaggagctgggcaccgttccaattctgttcctccacatgacgccctgttctgtttccgtgtggccaggactccgcttgctcgctgctgttttctacttcggaccaaagtgtgatatatcgttgctttctgtatatgtatgtaggaatgcatcatgtaacgagaatttggaatacaattgcgtgagtttttatccgatcacaatctattgagtagtggcatataaaaaatgtcctgccctttctttaaacgaatgaaagtaaagaaaagaacctcacg

SEQ ID NO: 493 - protein, 288 aa, Zea mays
  misc_feature: Ceres CLONE ID NO.229381
  misc_feature (33)..(270): Pfam Name: MIP Pfam Description: Major intrinsic protein
  misc_feature (1)..(288): Functional Homolog of  Ceres CLONE NO.33231 at SEQ ID NO.473 with e-value of 1.10E-122 and BLAST sequence identity of 82.2
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 494 - DNA, 1296 bp, Glycine max
  misc_feature: Ceres CLONE ID no.624259
  misc_feature: Encodes the peptide sequence at SEQ ID NO 495
cttcaattcactccactttggcacacaacactagctatagtaagctacacttatttgaggttggagaaatatggctaaagatgttgaggttcaagagcaaggaggagagtactctgcaaaagactaccatgaccctcctccagcacccttgttcgacccagaggagctcacacagtggtccttttatagagccctaatcgctgagttcatagcaacccttctcttcctttatgtcaccgtgctcaccattattggctacaaaaggcagactgatgccacgctaggtggcaccgagtgtgatggggttggcattttgggcatcgcttgggcctttggtggcatgatcttcatccttgtttactgcaccgccggtatttcaggaggacacataaacccggcggtgacattcgggctgttcctaggacgcaaggtttcgttgataagggcgttgttgtacatggtagcacagtgtgccggtgctatctgtggcactggattggccaaggggttccaaaaatcatactacaacaggtatggaggtggtgccaactctgttgctgatggctacaacaatggtactgctttgggtgctgagattattggtaccttcgttcttgtctacactgtcttctctgccactgaccctaagaggaacgctagggactcccatgttcctgtactggcaccacttcctattggatttgccgtgttcatggttcacttggctacaatcccaattactggtactggcattaacccagcaaggagtttcggagcagctgtaatctacaacaaggacaaaatctgggatgaccagtggatattctgggttggaccaattgttggagcagcagtggctgcattctaccaccaatacatccttagagcagcagctatcaaggctcttggatccttcagaagcaacgcttaattaattaatcaattaagctaccttaatttgccaacaaggctagctatgagtggtgtttccccggaagaataataatttctatgttgaggagtgccagtgatctgtctctgcagttccctaatttaggctttttcgttttttcctttcatcagctacaattgttggagggtttggaggataaggccaaaaccatagggtcatgcatcaaattgtggataagcatgcttgtgtccaagggtgtattttgtatcccttttgtgtcttttctttttcctttttataatttccatgtatgtattcctcaagtgttccttttcggtcttgtgcatccttagtcatttctgattttaaaaaaaaaaaaaaaa

SEQ ID NO: 495 - protein, 286 aa, Glycine max
  misc_feature: Ceres CLONE ID NO.624259
  misc_feature (32)..(267): Pfam Name: MIP Pfam Description: Major intrinsic protein
  misc_feature (1)..(286): Functional Homolog of  Ceres CLONE NO.33231 at SEQ ID NO.473 with e-value of 4.50E-126 and BLAST sequence identity of 81.9
MAKDVEVQEQGGEYSAKDYHDPPPAPLFDPEELTQWSFYRALIAEFIATLLFLYVTVLTIIGYKRQTDATLGGTECDGVGILGIAWAFGGMIFILVYCTAGISGGHINPAVTFGLFLGRKVSLIRALLYMVAQCAGAICGTGLAKGFQKSYYNRYGGGANSVADGYNNGTALGAEIIGTFVLVYTVFSATDPKRNARDSHVPVLAPLPIGFAVFMVHLATIPITGTGINPARSFGAAVIYNKDKIWDDQWIFWVGPIVGAAVAAFYHQYILRAAAIKALGSFRSNA

SEQ ID NO: 496 - DNA, 1263 bp, Glycine max
  misc_feature: Ceres CLONE ID no.1020667
  misc_feature: Encodes the peptide sequence at SEQ ID NO 497
accaccacagagagctaagcgcattcgcatcttgagcacagacacccaccctagcttgtcgatcagtcgaggcagcgacgatggccaaggacatcgaggcggcgccccccggaggggagtacggagccaaggactactctgacccgccgccggcgccgctcttcgacgccgaggagctgactaaatggtccctgtaccgcgcggtcatcgccgagttcgtggccacgctgctcttcctctacatcaccgtggccactgtcatcgggtacaagcaccaggcggaccccgccggccccaatgctgccgacgcggcctgcagcggcgtcggcatcctcggcatcgcctgggcgttcggcggcatgatcttcgtgctcgtctactgcactgccggggtttccggtggccacatcaacccggcggtgacgttcgggctgttcctggcgcggaaggtgtcgctggtgcgcgcgctgctctacatcatcgcgcagtgcctgggcgccatctgcggcgtcgggctcgtcaaggggttccagagcgccttctacgtgcgctacggcggcggcgccaacgagctcagctccggcttctccaagggcaccggcctcgccgccgagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatcccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggaactagatcggccgactgcagtatggatgatcggaagcacggacagtagatatatcagtgtgatactgttcgggtgatgtattgtgcacgcgtctgtattttcttagacgcgtttgggtgtcttcaaaatttctctacaattgcactaaattcgaaggactcgtcaccatgtgttttttttgaacaaacaaagggtacggaaggacctagaagttgcattaactaggaagaagtggatcacattgttttacaacaggacactaaaagaaaaatgaaacaacaaactagtgcctagttactaaaaaaaaaaaaaaaa

SEQ ID NO: 497 - protein, 290 aa, Glycine max
  misc_feature: Ceres CLONE ID NO.1020667
  misc_feature (32)..(270): Pfam Name: MIP Pfam Description: Major intrinsic protein
  misc_feature (1)..(290): Functional Homolog of  Ceres CLONE NO.33231 at SEQ ID NO.473 with e-value of 4.89E-120 and BLAST sequence identity of 80.6
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRN

SEQ ID NO: 498 - DNA, 1332 bp, Glycine max
  misc_feature: Ceres CLONE ID no.1368057
  misc_feature: Encodes the peptide sequence at SEQ ID NO 499
ccccaccacacaccccaagcccccacctccattttttccagccaggtttgcagcgagaaggaacagcaaggctagctacacaagccgatggccaaggacgaggtgatggagaccggcggcggcggcgacttcgcggccaaggactacacggacccgccgccggccccgctgatcgacgcggccgagctggcctcctggtcgctctaccgcgccgtcatcgccgagttcatcgccacgctgctcttcctctacatcaccgtggccaccgtcatcgggtacaagcaccagacggacccggcggtgaacagcgccgccgacgcagcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtgtccctggtccgcgcgctgctctacatgattgcgcagtgcctcggcgccatgtgcggggtcggcctcgtcaagaccttccagagcgcctacttcgtcaggtacggcggcggcgccaacacgctcgccgccggctactccaagggcaccggcctcgctgcggagatcatcggcaccttcgtgctcgtctacaccgtcttctccgccaccgaccccaagcgcagcgcacgcgactctcacgtcccggtgctggcgcccctcccgatcggcttcgccgtgttcatggtccacctggccaccatccccatcaccgtcaccggcatcaacccggcccggagcctgggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtcatctgtatgcaagactgaagcaatggcgacccgtgttgtgtccatccatccagagagaaatgcgcttttgcaacttctcgacagttcagttcggccgccgcaatggtcgtgttattatgtgtcggcagctgcatatgcgtagtacgtggtccggtcatgcgtgccgtgtcttgtaattcggtccatgggatcgcttgtcttaattagcccgcattgcttttcctacttgtatttaaatttagcgaccatatgtatgatcgatccaacgtcgccacctttctatctaagtcatcaatccaccaagcaagtgatcatcccaaaaaaaaaaaaaaaaaaagaaaaaaaaaaaaaaaa

SEQ ID NO: 499 - protein, 290 aa, Glycine max
  misc_feature: Ceres CLONE ID NO.1368057
  misc_feature (33)..(271): Pfam Name: MIP Pfam Description: Major intrinsic protein
  misc_feature (1)..(290): Functional Homolog of  Ceres CLONE NO.33231 at SEQ ID NO.473 with e-value of 2.10E-119 and BLAST sequence identity of 80.5
MAKDEVMETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKTFQSAYFVRYGGGANTLAAGYSKGTGLAAEIIGTFVLVYTVFSATDPKRSARDSHVPVLAPLPIGFAVFMVHLATIPITVTGINPARSLGAAVIYNKDKAWDDQWIFWVGPMIGAAIAAFYHQYILRAGAIKALGSFRSNA

SEQ ID NO: 500 - DNA, 855 bp, Populus balsamifera subsp. trichocarpa
  misc_feature: Ceres ANNOT ID no.1515353
  misc_feature: Encodes the peptide sequence at SEQ ID NO 501
atggcgaaggatattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctgtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaa

SEQ ID NO: 501 - protein, 284 aa, Populus balsamifera subsp. trichocarpa
  misc_feature: Ceres ANNOT ID NO.1515353
  misc_feature (30)..(265): Pfam Name: MIP Pfam Description: Major intrinsic protein
  misc_feature (1)..(284): Functional Homolog of  Ceres CLONE NO.33231 at SEQ ID NO.473 with e-value of 2.20E-126 and BLAST sequence identity of 84.0
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPVLAPLPIGFAVFMVHLATIPITGTGINPARSFGAAVIFNQSKAWDDHWLFWVGPFIGAAIAAFYHQFILRAAAIKALGSFRSNA

SEQ ID NO: 502 - DNA, 1098 bp, Zea mays
  misc_feature: Ceres CLONE ID no.1445059
  misc_feature: Encodes the peptide sequence at SEQ ID NO 503
accacagagagctaagcgcattcgcatcttgagcacagacacccaccctagcttgtcgatcagtcgaggcagcgacgatggccaaggacatcgaggcggcgccccccggaggggagtacggagccaaggactactctgacccgccgccggcgccgctcttcgacgccgaggagctgactaaatggtccctgtaccgcgcggtcatcgccgagttcgtggccacgctgctcttcctctacatcaccgtggccactgtcatcgggtacaagcaccaggcggaccccgccggccccaatgctgccgacgcggcctgcagcggcgtcggcatcctcggcatcgcctgggcgttcggcggcatgatcttcgtgctcgtctactgcactgccggggtttccggtggccacatcaacccggcggtgacgttcgggctgttcctggcgcggaaggtgtcgctggtgcgcgcgctgctctacatcatcgcgcagtgcctgggcgccatctgcggcgtcgggctcgtcaaggggttccagagcgccttctacgtgcgctacggcggcggcgccaacgagctcagctccggcttctccaagggcaccggcctcgccgccgagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatcccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggaactagatcggccgactgcagtatggatgatcggaagcacggacagtagatatatcagtgtgatactgttcgggtgatgtattgtgcacgcgtctgtattttcttagacgcgtttgggtgtcttcaaaatttctctacaaaaaaaaaaaaaaaa

SEQ ID NO: 503 - protein, 290 aa, Zea mays; identical to SEQ ID NO: 497
  misc_feature: Ceres CLONE ID NO.1445059
  misc_feature (32)..(270): Pfam Name: MIP Pfam Description: Major intrinsic protein
  misc_feature (1)..(290): Functional Homolog of  Ceres CLONE NO.33231 at SEQ ID NO.473 with e-value of 4.89E-120 and BLAST sequence identity of 80.6

SEQ ID NO: 504 - DNA, 440 bp, Brassica napus
  misc_feature: Ceres CLONE ID no.1095849
  misc_feature: Encodes the peptide sequence at SEQ ID NO 505
atcataataaccaaaaacacatttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcgtgggctttcggcggcatgatcttcatccttgtctactgcaccgccggtatctcaggtggtcacataaacccggcggtgacgttcggcttattcttggcccggaaggtatcgctggttagagcggttctatacatggtggctcagtgtt

SEQ ID NO: 505 - protein, 283 aa, Brassica napus
  misc_feature: Ceres CLONE ID NO.1095849
  misc_feature (29)..(264): Pfam Name: MIP Pfam Description: Major intrinsic protein
  misc_feature (1)..(283): Functional Homolog of  Ceres CLONE NO.33231 at SEQ ID NO.473 with e-value of 5.30E-52 and BLAST sequence identity of 80.9
MAKDVEGAEGVTARDYEDPPPTPFFDAEELTKWSLYRAVIAEFVATLLFLYVTVLTVIGYKISSDTKAGGDDCGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 506 - DNA, 1202 bp, Zea mays
  misc_feature: Ceres CLONE ID no.1390684
  misc_feature: Encodes the peptide sequence at SEQ ID NO 507
acaaatcaagagctaactctatataaagaaccatttgctctagcttattctcacaaccggaagcaaaagtaaaacagttcctaagaagaaacatccattacatataataatactacatggctaaagacgtggaaggagcagaggggttcgcggcgagggactacgaagatccgccgccaacaccgttcttcgatgcggaggagctgaccaagtggtctttgtacagagccgtcatagccgagttcgtagccactctcctcttcttgtatgtcactgttttgactgtcatcggctacaagatttcgtccgacactaaggccggaggcgacgagtgcggaggcgtcggaatccttggcatctcatgggccttcggcggcatgatcttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagccttccaaagctcttactacgtccgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcaccggaaccggtattaacccggccaggagtttcggagctgcggtgatctacaacgagtccaagccgtgggatgaccactggatattctgggtgggaccattcatcggagctgccatagctgcattttatcaccaattcgttctaagggcctctggttccaaatccctcggatccttcagaagtgcagccaacgtttgagtttagccacacaaaacaaaacaaaaaaagtggttactgttatgtataaattgggcacgtgattttaaaatgtgtcctcttatgtcttttcttttcatctgcttctatttgtgtgaattccaattattgaagttttagtgttttgcgtgttttcatcatggcaatgtcagtgagtttgtttattgagaaaaagccgaccacattgtttcgcgaaaaaaaaaaaaaaaa

SEQ ID NO: 507 - protein, 285 aa, Zea mays
  misc_feature: Ceres CLONE ID NO.1390684
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 4.50E-126 and BLAST sequence identity of 84.6
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 508 - protein, 285 aa, Arabidopsis thaliana
  misc_feature: Public GI ID NO.472879
  misc_feature (29)..(264): Pfam Name: MIP Pfam Description: Major intrinsic protein
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 2.49E-125 and BLAST sequence identity of 84.2
MAKDVEGPEGFQTRDYEDPPPTPFFDADELTKWSLYRAVIAEFVATLLFLYITVLTVIGYKIQSDTKAGGVDCGGVGILGIAWAFGGMIFILVYCTAGISGGHINPAVTFGLFLARKVSLIRAVLYMVAQCLGAICGVGFRQSFQSSYYDRYGGGANSLADGYNTGTGLAAEIIGTFVLVYTVFSATDPKRNARDSHVPVLAPLPIGFAVFMVHLATIPITGTGINPARSFGASVIYNKSKPWDDHWIFWVGPFIGAAIAAFYHQFVLRASGSKSLGSFRSAANV

SEQ ID NO: 509 - protein, 287 aa, Mesembryanthemum crystallinum
  misc_feature: Public GI ID NO.1657948
  misc_feature (33)..(268): Pfam Name: MIP Pfam Description: Major intrinsic protein
  misc_feature (1)..(287): Functional Homolog of  Ceres CLONE NO.33231 at SEQ ID NO.473 with e-value of 9.99E-127 and BLAST sequence identity of 83.0
MTKDVEVAEQQAPEFSAKDYHDPPPAPLIDFEELRKWSFYRAVIAEFIATLLFLYITVLTVIGYKSQTDPNTNADQCGGVGILGIAWAFGGMIFILVYCTAGISGGHINPAVTFGLFLARKVSLIKAVLYMVAQCLGAICGVGFVKAFQKAYYVRYGGGANEMASGYTKGTGLGAEIIGTFVLVYTVFAATDPKRNARDSHVPVLAPLPIGFAVFMVHLATIPITGTGINPARSFGAAVIYNQQKAWDDHWIFWVGPFIGAAIAAFYHQYILRAAAIKALGSFRSSA

SEQ ID NO: 510 - protein, 290 aa, Oryza sativa
  misc_feature: Public GI ID NO.3135543
  misc_feature (34)..(271): Pfam Name: MIP Pfam Description: Major intrinsic protein
  misc_feature (1)..(290): Functional Homolog of  Ceres CLONE NO.33231 at SEQ ID NO.473 with e-value of 3.00E-120 and BLAST sequence identity of 81.5
MGKDEVMESGGAAGEFAAKDYTDPPPAPLIDAAELGSWSLYRAVIAEFIATLLFLYITVATVIGYKHQTDASASGADAACGGVGVLGISWAFGGMIFILVYCTAGISGGHINPAVTFGLFLARKVSLVRAILYIVAQCLGAICGVGLVNAFPNAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 511 - protein, 287 aa, Samanea saman
  misc_feature: Public GI ID NO.3158476
  misc_feature (31)..(266): Pfam Name: MIP Pfam Description: Major intrinsic protein
  misc_feature (1)..(287): Functional Homolog of  Ceres CLONE NO.33231 at SEQ ID NO.473 with e-value of 8.40E-125 and BLAST sequence identity of 81.2
MAKDVEVAERGSYSAKDYHDPPPAPLIDAEELGKWSFYRALIAEFIATLLFLYITVLTVIGYKSQSDTKAGGDVCGGVGILGIAWAFGGMIFILVYCTAGISGGHINPAVTFGLFLARKVSLIRAILYMVAQCLGAICGVGLVKAFQKAYYSRYGGGANTLSDGYSTGTGLGAEIIGTFVLVYTVFSATDPKRSARDSHVPVLAPLPIGFAVFMVHLATIPVTGTGINPARSLGAAVIFNQQKAWDDHWIFWVGPFIGAAIAAFYHQFILRAGAAKALGSFRSNPSV

SEQ ID NO: 512 - protein, 287 aa, Raphanus sativus
  misc_feature: Public GI ID NO.3551133
  misc_feature (31)..(266): Pfam Name: MIP Pfam Description: Major intrinsic protein
  misc_feature (31)..(266): Pfam Name: MIP Pfam Description: Major intrinsic protein
  misc_feature (1)..(287): Functional Homolog of  Ceres CLONE NO.33231 at SEQ ID NO.473 with e-value of 1.99E-125 and BLAST sequence identity of 82.3
MAKDVEAVSGEGFQTRDYQDPPPAPLFDPEELTKWSFYRAVIAEFVATLLFLYITVLTVIGYKIETDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 513 - protein, 285 aa, Arabidopsis thaliana
  misc_feature: Public GI ID NO.4371284
  misc_feature (29)..(264): Pfam Name: MIP Pfam Description: Major intrinsic protein
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 2.90e-127 and BLAST sequence identity of 85.7
MAKDVEGPEGFQTRDYEDPPPTPFFDADELTKWSLYRAVIAEFVATLLFLYITVLTVIGYKIQSDTKAGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 514 - protein, 285 aa, Zea mays
  misc_feature: Public GI ID NO.4741931
  misc_feature (29)..(266): Pfam Name: MIP Pfam Description: Major intrinsic protein
  misc_feature (1)..(285): Functional Homolog of  Ceres CLONE NO.33231 at SEQ ID NO.473 with e-value of 9.00E-121 and BLAST sequence identity of 81.4
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYNNDKAWDDHWIFWVGPFIGAAIAAAYHQYVLRASAAKLGSSASFSR

SEQ ID NO: 515 - protein, 291 aa, Mesembryanthemum crystallinum
  misc_feature: Public GI ID NO.4884864
  misc_feature (32)..(269): Pfam Name: MIP Pfam Description: Major intrinsic protein
  misc_feature (1)..(291): Functional Homolog of  Ceres CLONE NO.33231 at SEQ ID NO.473 with e-value of 3.80E-122 and BLAST sequence identity of 80.5
MAKDFETGGGEVRDVAKDYQDPPPSPLFDMEELTKWSFYRALIAEFIATLLFLYITVLTVIGYKHQSDPLVSGADAGCGGVGILGIAWAFGGMIFILVYCTAGISGGHINPAVTFGLFLARKLSLIRAIMYMVAQCLGAICGVGFVKAFQSAYYNKYGGGANELSVGYSKGTGLAAEIIGTFVLVYTVFSATDPKRSARDSHVPVLAPLPIGFAVFMVHLATIPITGTGINPARSLGAAVIYNNNKAWDDQWIFWVGPFIGAAIAAIYHQYILRAGFIKALGSFRSSTSNV

SEQ ID NO: 516 - protein, 287 aa, Brassica napus
  misc_feature: Public GI ID NO.5081421
  misc_feature (31)..(266): Pfam Name: MIP Pfam Description: Major intrinsic protein
  misc_feature (31)..(266): Pfam Name: MIP Pfam Description: Major intrinsic protein
  misc_feature (1)..(287): Functional Homolog of  Ceres CLONE NO.33231 at SEQ ID NO.473 with e-value of 2.49E-125 and BLAST sequence identity of 82.3
MAKDVEAVSGEGFQTRDYQDPPPAPLFDPAELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 517 - protein, 283 aa, Brassica napus; identical to SEQ ID NO: 505
  misc_feature: Public GI ID NO.5081423
  misc_feature (29)..(264): Pfam Name: MIP Pfam Description: Major intrinsic protein
  misc_feature (1)..(283): Functional Homolog of  Ceres CLONE NO.33231 at SEQ ID NO.473 with e-value of 7.39E-126 and BLAST sequence identity of 84.3

SEQ ID NO: 518 - protein, 283 aa, Raphanus sativus
  misc_feature: Public GI ID NO.7209560
  misc_feature (29)..(264): Pfam Name: MIP Pfam Description: Major intrinsic protein
  misc_feature (1)..(283): Functional Homolog of  Ceres CLONE NO.33231 at SEQ ID NO.473 with e-value of 3.20E-125 and BLAST sequence identity of 83.9
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 519 - protein, 283 aa, Raphanus sativus
  misc_feature: Public GI ID NO.7209562
  misc_feature (29)..(264): Pfam Name: MIP Pfam Description: Major intrinsic protein
  misc_feature (1)..(283): Functional Homolog of  Ceres CLONE NO.33231 at SEQ ID NO.473 with e-value of 1.19E-125 and BLAST sequence identity of 83.9
MAKDVEGAEGVTARDYEDPPPTPFFDAEELTKWSLYRAVIAEFVATLLFLYITVLTVIGYKISSDTKAGGDECGGVGILGIAWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 520 - protein, 291 aa, Allium cepa
  misc_feature: Public GI ID NO.7649310
  misc_feature (34)..(272): Pfam Name: MIP Pfam Description: Major intrinsic protein
  misc_feature (1)..(291): Functional Homolog of  Ceres CLONE NO.33231 at SEQ ID NO.473 with e-value of 1.30E-121 and BLAST sequence identity of 81.8
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSRYGGGANTLNAGYSKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFGSNA

SEQ ID NO: 521 - protein, 284 aa, Vitis berlandieri x Vitis rupestris
  misc_feature: Public GI ID NO.8071620
  misc_feature (31)..(263): Pfam Name: MIP Pfam Description: Major intrinsic protein
  misc_feature (1)..(284): Functional Homolog of  Ceres CLONE NO.33231 at SEQ ID NO.473 with e-value of 5.80E-126 and BLAST sequence identity of 84.2
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAIKALGSFRSTPRV

SEQ ID NO: 522 - protein, 290 aa, Zea mays; identical to SEQ ID NO: 489
  misc_feature: Public GI ID NO.13447801
  misc_feature (34)..(271): Pfam Name: MIP Pfam Description: Major intrinsic protein
  misc_feature (1)..(290): Functional Homolog of  Ceres CLONE NO.33231 at SEQ ID NO.473 with e-value of 4.20E-123 and BLAST sequence identity of 83.3

SEQ ID NO: 523 - protein, 292 aa, Zea mays
  misc_feature: Public GI ID NO.13447803
  misc_feature (34)..(273): Pfam Name: MIP Pfam Description: Major intrinsic protein
  misc_feature (1)..(292): Functional Homolog of  Ceres CLONE NO.33231 at SEQ ID NO.473 with e-value of 2.39E-120 and BLAST sequence identity of 81.2
MGKDDVVQSGAGGGEFAAKDYTDPPPAPLVDAAELGSWSLYRAVIAEFIATLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 524 - protein, 289 aa, Zea mays
  misc_feature: Public GI ID NO.13447805
  misc_feature (34)..(271): Pfam Name: MIP Pfam Description: Major intrinsic protein
  misc_feature (1)..(289): Functional Homolog of  Ceres CLONE NO.33231 at SEQ ID NO.473 with e-value of 2.90E-122 and BLAST sequence identity of 82.9
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 525 - protein, 288 aa, Zea mays
  misc_feature: Public GI ID NO.13447807
  misc_feature (33)..(270): Pfam Name: MIP Pfam Description: Major intrinsic protein
  misc_feature (1)..(288): Functional Homolog of  Ceres CLONE NO.33231 at SEQ ID NO.473 with e-value of 1.10E-122 and BLAST sequence identity of 81.9
MAKDIEASGPEAGEFSAKDYTDPPPAPLIDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 526 - protein, 281 aa, Pyrus communis
  misc_feature: Public GI ID NO.13486938
  misc_feature (31)..(262): Pfam Name: MIP Pfam Description: Major intrinsic protein
  misc_feature (1)..(281): Functional Homolog of  Ceres CLONE NO.33231 at SEQ ID NO.473 with e-value of 5.20E-125 and BLAST sequence identity of 83.8
MAKDVEVAEHGEFAAKDYHDPPPTPLFDAEELTKWSFYRALIAEFIATLLFLYITVLTVIGYKSQSEADQCGGVGILGIAWAFGGMIFVLVYCTAGISGGHINPAVTFGLFLARKVSLIRAVLYIIAQCLGAICGVGLVKAFQKSYYVKYGGGANELSAGYNKGTGLGAEIIGTFVLVYTVFSATDPKRNARDSHVPVLAPLPIGFAVFIVHLATIPITGTGINPARSLGAAVIYNKDKAWDDQWIFWLGPFIGAAIAAFYHQYILRAGAIKALGSFRSNA

SEQ ID NO: 527 - protein, 287 aa, Pyrus communis
  misc_feature: Public GI ID NO.13486942
  misc_feature (31)..(266): Pfam Name: MIP Pfam Description: Major intrinsic protein
  misc_feature (1)..(287): Functional Homolog of  Ceres CLONE NO.33231 at SEQ ID NO.473 with e-value of 9.00E-121 and BLAST sequence identity of 80.9
MAKDMEVAERGSFSAKDYHDPPPAPLIDAAELTKWSFYRALIAEFVATLLFLYVTVLTVIGYKSQTDPAVNADACGGVGILGIAWAFGGMIFVLVYCTAGISGGHINPAVTFGLFLARKVSLVRAVLYMVAQSLGAIAGVALVKAFQKSYYIKYGGGANSLSDGYSTGVGLAAEIIGTFVLVYTVFSATDPKRSARDSHVPVLAPLPIGFAVFIVHLATIPITGTGINPARSLGAAVIYNKDKAWDDQWIFWVGPFIGAAIAAFYHQFILRAGAVKALGSFRSNPHV

SEQ ID NO: 528 - protein, 285 aa, Arabidopsis thaliana
  misc_feature: Public GI ID NO.20465733
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 1.90e-125 and BLAST Sequence identity of 83.6
MAKDVEGPDGFQTRDYEDPPPTPFFDAEELTKWSLYRAVIAEFVATLLFLYVTVLTVIGYKIQSDTKAGGVDCGGVGILGIAWAFGGMIFILVYCTAGISGGHINPAVTFGLFLARKVSLIRAVLYMVAQCLGAICGVGFVKAFQSSHYVNYGGGANFLADGYNTGTGLAAEIIGTFVLVYTVFSATDPKRNARDSHVPVLAPLPIGFAVFMVHLATIPITGTGINPARSFGAAVIFNKSKPWDDHWIFWVGPFIGATIAAFYHQFVLRASGSKSLGSFRSAANV

SEQ ID NO: 529 - protein, 285 aa, Arabidopsis thaliana; identical to SEQ ID NO: 487
  misc_feature: Public GI ID NO.21537097
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 2.49E-125 and BLAST sequence identity of 83.6

SEQ ID NO: 530 - protein, 285 aa, Arabidopsis thaliana
  misc_feature: Public GI ID NO.21554356
  misc_feature (29)..(264): Pfam Name: MIP Pfam Description: Major intrinsic protein
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 9.99E-127 and BLAST sequence identity of 85.3
MAKDVEGPEGFQTRDYEDPPPTPFFDADELTKWSLYRAVIAEFVATLLFLYITVLTVIGYKIQSDTKVGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 531 - protein, 287 aa, Juglans regia
  misc_feature: Public GI ID NO.28395418
  misc_feature (31)..(266): Pfam Name: MIP Pfam Description: Major intrinsic protein
  misc_feature (1)..(287): Functional Homolog of  Ceres CLONE NO.33231 at SEQ ID NO.473 with e-value of 9.39E-126 and BLAST sequence identity of 81.6
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWNDQWIFWVGPFIGAAIAAFYHQYILRAGAAKALGSFRSSSTI

SEQ ID NO: 532 - protein, 287 aa, Juglans regia
  misc_feature: Public GI ID NO.28395420
  misc_feature (31)..(266): Pfam Name: MIP Pfam Description: Major intrinsic protein
  misc_feature (1)..(287): Functional Homolog of  Ceres CLONE NO.33231 at SEQ ID NO.473 with e-value of 9.99E-127 and BLAST sequence identity of 82.3
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWDDQWIFWVGPFIGAAIAAFYHQYILRAAAAKALGSFRSSSHM

SEQ ID NO: 533 - protein, 290 aa, Zea mays
  misc_feature: Public GI ID NO.29650727
  misc_feature (34)..(271): Pfam Name: MIP Pfam Description: Major intrinsic protein
  misc_feature (1)..(290): Functional Homolog of  Ceres CLONE NO.33231 at SEQ ID NO.473 with e-value of 1.10E-122 and BLAST sequence identity of 82.9
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGFGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 534 - protein, 283 aa, Oryza sativa subsp. japonica
  misc_feature: Public GI ID NO.34901254
  misc_feature (28)..(265): Pfam Name: MIP Pfam Description: Major intrinsic protein
  misc_feature (1)..(283): Functional Homolog of  Ceres CLONE NO.33231 at SEQ ID NO.473 with e-value of 6.00e-120 and BLAST sequence identity of 81.4
MGKEADVEAGGVRDYEDPPPAPLVDIDELGRWSLYRAVIAEFVATLLFLYVTVATVIGYKHQTDASASGDDAACGGVGVLGIAWAFGGMIFILVYCTAGISGGHINPAVTFGLFLARKVSLVRAILYIVAQCLGAVCGVALVKGFQSSFYDRYGGGANELAAGYSKGTGLAAEIIGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 535 - protein, 288 aa, Oryza sativa
  misc_feature: Public GI ID NO.50910761
  misc_feature (33)..(270): Pfam Name: MIP Pfam Description: Major intrinsic protein
  misc_feature (1)..(288): Functional Homolog of  Ceres CLONE NO.33231 at SEQ ID NO.473 and e-value of 8.30e-123 and BLAST sequence identity of 81.6
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 536 - protein, 290 aa, Oryza sativa
  misc_feature: Public GI ID NO.50926544
  misc_feature (34)..(271): Pfam Name: MIP Pfam Description: Major intrinsic protein
  misc_feature (1)..(290): Functional Homolog of  Ceres CLONE NO.33231 at SEQ ID NO.473 with e-value of 1.40e-118 and BLAST sequence identity of 80.6
MAKDIEAAAAAEGGEYMAKDYSDPPPAPLIDAEELTKWSLYRAVIAEFVATLLFLYITVATVIGYKHQSDPGANAADAACSGVGILGIAWAFGGMIFILVYCTAGVSGGHINPAVTFGLFLARKVSLVRAVLYIVAQSLGAICGVGLVKGFQSAFYVRYGGGANELSDGYSKGTGLAAEIIGTFVLVYTVFSATDPKRNARDSHVPVLAPLPIGFAVFMVHLATIPITGTGINPARSLGAAVIYNQHKAWHDHWIFWVGPLIGAAIAAAYHQYVLRASAAKLGSSSSFRG

SEQ ID NO: 537 - protein, 284 aa, Vitis vinifera
  misc_feature: Public GI ID NO.55982653
  misc_feature (31)..(263): Pfam Name: MIP Pfam Description: Major intrinsic protein
  misc_feature (1)..(284): Functional Homolog of  Ceres CLONE NO.33231 at SEQ ID NO.473 with e-value of 7.39E-126 and BLAST sequence identity of 83.9
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTTHV

SEQ ID NO: 538 - protein, 284 aa, Aegiceras corniculatum
  misc_feature: Public GI ID NO.56131022
  misc_feature (30)..(265): Pfam Name: MIP Pfam Description: Major intrinsic protein
  misc_feature (1)..(284): Functional Homolog of  Ceres CLONE NO.33231 at SEQ ID NO.473 with e-value of 7.60E-124 and BLAST sequence identity of 82.2
MAKDIEVGPGANAPKDYQDPPPAPLIDAEELTKWSLYRAVIAEFIATLLFLYITVLTVIGYSSQTDPDKNPDDCGGVGILGIAWAFGGMIFVLVYCTAGISGGHINPAVTLGLFLAQKVSLVRAMLYMMAQCLGAICGCGLVKAFQKSYYTKYGGGANYLHDGYNKGTGLGAEIIGTFVLVYTVFSATDPKRSARDSHVPVLAPLPIGFAVFMVHLATIPITGTGINPARSLGAAVIYGKKKTWDDQWIFWGGPFIGAPIAAFYHQFILRAGAIKALGSYRSNA

SEQ ID NO: 539 - protein, 285 aa, Populus tremula x Populus tremuloides
  misc_feature: Public GI ID NO.57336896
  misc_feature (31)..(264): Pfam Name: MIP Pfam Description: Major intrinsic protein
  misc_feature (1)..(285): Functional Homolog of  Ceres CLONE NO.33231 at SEQ ID NO.473 with e-value of 2.60E-121 and BLAST sequence identity of 80.3
MAKDMEVAEAGSFSAKDYHDPPPAPLFDAKELTKWSFYRALIAEFIATLLFLYITVLTVIGYKSQIDGSADSCGGVGILGIALAFGGMIFVLVYCTAGISGGHINPAVTFGLFLARKVSLIRAVMYMVAQCLGAICGVGLVKAFQKSYYKKYGGGANTLADGFSIGTGLGAEIIGTFVLVYTVFSATDPKRSARDSHVPVLAPLPIGFAVFMVHLATIPITGTGINPARSLGAAVIYNQDKAWDHHWIFWVGPFAGAAIAAFYHQFILRAGAVKALGSFRSAQRF

SEQ ID NO: 540 - protein, 285 aa, Populus tremula x Populus tremuloides
  misc_feature: Public GI ID NO.57336898
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 8.40E-125 and BLAST sequence identity of 82.5
MGKDIEVGGEFIAKDYHDPPPAPLIDAEELTQWSLYRAVIAEFIATLLFLYITVLTVIGYKSQTDTAKNGDVCGGVGVLGIAWAFGGMIFVLVYCTAGISGGHINPAVTFGLFLARKVSLVRAILYMVAQCLGAICGCGLVKAFQKSYYTKYGGGANGLASGFSKGTALGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 541 - protein, 283 aa, Astragalus membranaceus
  misc_feature: Public GI ID NO.58700408
  misc_feature (31)..(262): Pfam Name: MIP Pfam Description: Major intrinsic protein
  misc_feature (1)..(283): Functional Homolog of  Ceres CLONE NO.33231 at SEQ ID NO.473 with e-value of 6.60E-125 and BLAST sequence identity of 83.8
MGKDVEVAEHGEFSAKDYTDPPPAPLIDMAELASWSFYRAIIAEFIATLLFLYITVLTVIGYKSQSATDQCGGVGILGIAWAFGGMIFVLVYCTAGISGGHINPAVTFGLFLARKVSLIRAVMYMVAQCLGAICGVGFVKAFQKSYYVKFGGGANELADGYNKGTGLAAEIIGTFVLVYTVFSATDPKRSARDSHVPVLAPLPIGFAVFMVHLATIPITGTGINPARSFGAAVIYNKDKAWDDQWIFWVGPFVGAAIAAFYHQFVLRAAAIKALGSFRSNAHN

SEQ ID NO: 542 - protein, 287 aa, Mimosa pudica
  misc_feature: Public GI ID NO.60498685
  misc_feature (31)..(268): Pfam Name: MIP Pfam Description: Major intrinsic protein
  misc_feature (1)..(287): Functional Homolog of  Ceres CLONE NO.33231 at SEQ ID NO.473 with e-value of 6.29E-120 and BLAST sequence identity of 80.2
MTKDVEVQEQGDFSAKDYHEPPPAPLIDPEELGKWAFYRAVIAEFVATLLFLYVTILTIIGHNSSTDSKKGPGVTDCDGVGILGIAWAFGGMIFILVYCTAGISGGHINPAVTFGLFLGRKVSLIRAVLYMVAQCAGAICGTGLAKAFQKAYYDRYGGGVNFVQPGYSKGTALGAEIIGTFVLVYTVFSATDPKRNARDSHVPVLAPLPIGFAVFMVHLATIPVTGTGINPARSFGAAVIYNGSKAWDDHWIFWVGPAIGALAAAIYHQYILRAAAIKALGSFRSNN

SEQ ID NO: 543 - protein, 288 aa, Mimosa pudica
  misc_feature: Public GI ID NO.60498689
  misc_feature (31)..(267): Pfam Name: MIP Pfam Description: Major intrinsic protein
  misc_feature (1)..(288): Functional Homolog of  Ceres CLONE NO.33231 at SEQ ID NO.473 with e-value of 1.10E-124 and BLAST sequence identity of 82.3
MAKDVEVAERGSYSAKDYHDPPPAPLIDAEELGKWSFYRALIAEFIATLLFLYITVLTVIGYKSQTDTTVATGDVCGGVGILGIAWAFGGMIFILVYCTAGISGGHINPAVTFGLFLARKVSLIRAILYIVAQCLGAICGVGLVKAFQKAYYTKYGGGANTLGDGYSVGTGLGAEIIGTFVLVYTVFSATDPKRNARDSHVPVLAPLPIGFAVFMVHLATIPVTGTGINPARSFGAAVIFNQQKAWDKHWIFWVGPFIGAAIAAFYHQFILRAGAAKALGSFRSNPSV

SEQ ID NO: 544 - protein, 281 aa, Mimosa pudica
  misc_feature: Public GI ID NO.60498691
  misc_feature (28)..(260): Pfam Name: MIP Pfam Description: Major intrinsic protein
  misc_feature (1)..(281): Functional Homolog of  Ceres CLONE NO.33231 at SEQ ID NO.473 with e-value of 2.39E-120 and BLAST sequence identity of 81.5
MTKDLEGPPPPHKDYHDPPPAPLLDAAELGKWSFYRAVIAEFVATLLFLYITVLTVIGYKSQIDGGHDCDGVGVLGIAWAFGGMIFILVYCTAGISGGHINPAVTFGLFLARKVSLIRAIAYIVAQCLGAICGCGLVKAFQKAFYNRYGGGANTLSTGYSSGTGLGAEIIGTFVLVYTVFSATDPKRNARDSHVPVLAPLPIGFAVFMVHLTTIPITGTGINPARSFGAAVMYNNFEAWDDHWIFWVGPFIGAAIAAIYHQYVLRAQAAKALGSFRSSSHL

SEQ ID NO: 545 - protein, 285 aa, Phaseolus vulgaris
  misc_feature: Public GI ID NO.62945921
  misc_feature (31)..(266): Pfam Name: MIP Pfam Description: Major intrinsic protein
  misc_feature (1)..(285): Functional Homolog of  Ceres CLONE NO.33231 at SEQ ID NO.473 with e-value of 1.30E-126 and BLAST sequence identity of 81.9
MAKDVEVQEQGEYAAKDYQDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYIVAQCAGAICGTGLAKGFQKAYYNRCGGGANSVADGYNKGTALGAEIIGTFALVYTVFSATDPKRNARDSHVPVLAPLPIGFAVFMVHLATIPVTGAGINPARSFGAAVIYNNEKIWDDQWIFWVGPIIGAAVAAFYHQYILRAAAIKALGSFRSNA

SEQ ID NO: 546 - protein, 286 aa, Hordeum vulgare
  misc_feature: Public GI ID NO.68299599
  misc_feature (32)..(269): Pfam Name: MIP Pfam Description: Major intrinsic protein
  misc_feature (1)..(286): Functional Homolog of  Ceres CLONE NO.33231 at SEQ ID NO.473 with e-value of 4.89E-120 and BLAST sequence identity of 80.1
MAKDIEAAPQGGEFSSKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 547 - protein, 287 aa, Arabidopsis thaliana
  misc_feature: Public GI ID NO.79314872
  misc_feature (31)..(266): Pfam Name: MIP Pfam Description: Major intrinsic protein
  misc_feature (31)..(266): Pfam Name: MIP Pfam Description: Major intrinsic protein
  misc_feature (1)..(287): Functional Homolog of  Ceres CLONE NO.33231 at SEQ ID NO.473 with e-value of 1.90e-125 and BLAST sequence identity of 82.7
MAKDVEAVPGEGFQTRDYQDPPPAPFIDGAELKKWSFYRAVIAEFVATLLFLYITVLTVIGYKIQSDTDAGGVDCGGVGILGIAWAFGGMIFILVYCTAGISGGHINPAVTFGLFLARKVSLPRALLYIIAQCLGAICGVGFVKAFQSSYYTRYGGGANSLADGYSTGTGLAAEIIGTFVLVYTVFSATDPKRSARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 548 - protein, 281 aa, Prunus mume
  misc_feature: Public GI ID NO.82568687
  misc_feature (31)..(262): Pfam Name: MIP Pfam Description: Major intrinsic protein
  misc_feature (1)..(281): Functional Homolog of  Ceres CLONE NO.33231 at SEQ ID NO.473 with e-value of 6.79E-123 and BLAST sequence identity of 83.8
MAKDVEGAEHGEFAAKDYHDPPPTPFFDAEELTKWSFYRALIAEFVATLLFLYITVLTVIGYKSQSSGDQCGGVGILGIAWAFGGMIFVLVYCTAGISGGHINPAVTFGLFLARKVSLPRAVLYIIAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAALYHQYILRAGAIKALGSFRSNA

SEQ ID NO: 549 - DNA, 1202 bp, Zea mays; identical to SEQ ID NO: 506
  misc_feature: Ceres CLONE ID no.1411718
  misc_feature: Encodes the peptide sequence at SEQ ID NO 550

SEQ ID NO: 550 - protein, 285 aa, Zea mays; identical to SEQ ID NO: 507
  misc_feature: Ceres CLONE ID NO.1411718
  misc_feature (29)..(264): Pfam Name: MIP Pfam Description: Major intrinsic protein
  misc_feature (1)..(285): Functional Homolog of  Ceres CLONE NO.33231 at SEQ ID NO.473 with e-value of 4.50E-126 and BLAST sequence identity of 84.6

SEQ ID NO: 551 - DNA, 1102 bp, Glycine max
  misc_feature: Ceres CLONE ID no.1508487
  misc_feature: Encodes the peptide sequence at SEQ ID NO 552
aaaaactcatcaatctcttcctctatatctctctcatcctcatcatctttggtcatggcaaaggacttggaggtgcaagatggcggagcaacggcggcgagagattatgttgatcctcctcccgctccattgttggacatggaggagtttgggaagtggtcgctctacagagcggtcatagctgagtttgtggcgacacttctcttcctttacgtctcagtcctcaccgtaatcgggtacaaagctcagaccgactcaaacgccggaggagttgactgcggcggcgttggaatattggggattgcatgggctttcggtggaatgatttttgttctcgtttactgtaccgccggtgtctccggtggtcatataaatccggctgtgacgttcggattgttcttagctagaaaagtgtcattggtgcggacagtgttatacattgtggctcagtgccttggtgctatctgcggttgcggtctggtcaaagcattccaaagttcttactacaccagatatggaggtggagccaacgagctagctgacggctacaacaaaggaaccggactaggtgcggagatcatcggcacatttgtcctagtctacaccgttttctcggccacagatcctaagcgaagtgcacgtgactctcacattccagttttggcgccacttcccattggctttgctgtcttcatggttcacctagccaccattcccatcaccggtaccggaatcaacccggcccgaagcttcggtgccgcagttatctacaaccaagaaaaggcctgggacgaccaatggattttctgggtgggaccaatgatcggagcagcagctgctgcattataccatcagtttgttctaagagcggctgggatcaaaagtcttggctcctttaggagctctgcgtaattttaattgtttaaaattaagccacaagttcatctttaataaaatgatgattactacaaattccactacctagaggaagttacgtttatctttttatttatgtactctgtttcttaatttcatggaattttcccttcggttgtaaatgttgtttaatttatgttgctttaagataaaaaaaaaaaaaaaa

SEQ ID NO: 552 - protein, 285 aa, Glycine max
  misc_feature: Ceres CLONE ID NO.1508487
  misc_feature (31)..(266): Pfam Name: MIP Pfam Description: Major intrinsic protein
  misc_feature (1)..(285): Functional Homolog of  Ceres CLONE NO.33231 at SEQ ID NO.473 with e-value of 7.79E-138 and BLAST sequence identity of 90.8
MAKDLEVQDGGATAARDYVDPPPAPLLDMEEFGKWSLYRAVIAEFVATLLFLYVSVLTVIGYKAQTDSNAGGVDCGGVGILGIAWAFGGMIFVLVYCTAGVSGGHINPAVTFGLFLARKVSLVRTVLYIVAQCLGAICGCGLVKAFQSSYYTRYGGGANELADGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAGIKSLGSFRSSA

SEQ ID NO: 553 - protein, 290 aa, Oryza sativa subsp. japonica
  misc_feature: Public GI ID NO.34901270
  misc_feature (34)..(271): Pfam Name: MIP Pfam Description: Major intrinsic protein
  misc_feature (1)..(290): Functional Homolog of  Ceres CLONE NO.33231 at SEQ ID NO.473 with e-value of 3.60e-122 of BLAST sequence identity of 83.0
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 554 - protein, 290 aa, Hordeum vulgare
  misc_feature: Public GI ID NO.68533200
  misc_feature (32)..(270): Pfam Name: MIP Pfam Description: Major intrinsic protein
  misc_feature (1)..(290): Functional Homolog of  Ceres CLONE NO.33231 at SEQ ID NO.473 with e-value of 7.00E-121 and BLAST sequence identity of 81.0
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRAVLYIIAQCLGAICGVGLVKGFQSAFYVRYGGGANELSAGYSKGTGLAAEIIGTFVLVYTVFSATDPKRSARDSHVPVLAPLPIGFAVFMVHLATIPITGTGINPARSFGAAVIYNNEKAWDDHWMFWVGPFIGAAIAALYHQYVLRASATKFGSSASFGSR

SEQ ID NO: 555 - DNA, 1527 bp, Arabidopsis thaliana
  misc_feature: Ceres CLONE ID no.33877
  misc_feature: Encodes the peptide sequence at SEQ ID NO 556
aggtcgcaacaccgcaatagatcttttccccaagtttcagacaaacataaagcagcagagaaaattttcaagtttcaaagagcttttccatcaccaagcaaatttggatatttgtcagcaaaatctgcagctaaattgggacttgtcttgttagttcaaagattgaaacttttttggttaattgtttggcggaagaagatttacaatgggagaggagcatccgagaaagcggtctagacaacattttgaagcggaggcgagaaacgtatcgttgtttgaatcccctcaatgcgaaacctccaagtggtatttcagcagggaagagattgagcgtttctctccatccagaaaagatgggattgatcttgtgaaggagtcgtttttacggtcttcgtattgcaccttcctgcaaagacttggcatgaagcttcatgtgtcccaggttacaatatcatgtgcaatggtgatgtgccacaggttttacatgcgccaatctcatgcaaaaaatgactggcagacaatagcgacttccagtctgttcctcgcttgcaaagctgaagatgagccatgtcaactgtccagtgtcgttgtagcgtcttatgaaataatttatgagtgggatccttctgcctcaattagaatccatcaaactgagtgttatcatgaatttaaagaaattattttgtccggggaaagtcttctgctgagcacaagtgctttccatttagacattgaacttccctacaaacctctggctgcggctttgaatagactgaacgcttggcctgaccttgcaacagctgcatggaattttgtgcatgactggattcgaaccacactatgcttgcagtacaaaccccatgttattgcaacagccactgtgcacctagctgctacgtttcagaatgcgaaagtaggcagcaggagagattggtggttggagtttggagttacaactaagctattaaaagaggtaatccaggagatgtgcacactgatagaagtggacagaaggaggaatatgccacctccacctccacctccaagaagagagttaagttgggcaatacctgcagccgtaaagccggtccatatggctagagcttatccgtttcacggctaccctttgcagtcctatagacaggctggcatctggtgagccattgttgagcagcatgaagatgtaatctctcttagagtcttgagttggtttatcaataaaagatttccgtagagactcatgagagaggcagtgtagcattatatagagatccgagtgaggtgcttctgtctaagttaagcgtctcatgtatgaccaaagtggattctctcgagattcttggtctctgttctcgatagagagagattatgtatagaagtgtcccattcacatgttataatactagctgactttatatcgtttgtatatctggaatctatgtttttggtttctttaaaaagtttaaagttgttttgattttgactaattctctcattgttaagtaatttggtttttgatgaagtgcc

SEQ ID NO: 556 - protein, 317 aa, Arabidopsis thaliana
  misc_feature: Ceres CLONE ID NO.33877
  misc_feature (31)..(175): Pfam Name: Cyclin_N Pfam Description: Cyclin, N-terminal domain
MGEEHPRKRSRQHFEAEARNVSLFESPQCETSKWYFSREEIERFSPSRKDGIDLVKESFLRSSYCTFLQRLGMKLHVSQVTISCAMVMCHRFYMRQSHAKNDWQTIATSSLFLACKAEDEPCQLSSVVVASYEIIYEWDPSASIRIHQTECYHEFKEIILSGESLLLSTSAFHLDIELPYKPLAAALNRLNAWPDLATAAWNFVHDWIRTTLCLQYKPHVIATATVHLAATFQNAKVGSRRDWWLEFGVTTKLLKEVIQEMCTLIEVDRRRNMPPPPPPPRRELSWAIPAAVKPVHMARAYPFHGYPLQSYRQAGIW

SEQ ID NO: 557 - DNA, 2044 bp, Zea mays
  misc_feature: Ceres CLONE ID no.354421
  misc_feature: Encodes the peptide sequence at SEQ ID NO 558
aaacagtaccgtgcctggcgattccgcgtccacgcacctctcagttagggtttcggactcgaggccaagttcatctccggacgagcataccgtgagccccaacgctccaggtggtccgcttcacttccgagcgcccctctcccgacagccgtctcctcctcaccgctgcttcatcacctagccgtcgccacccatcgcctacagcgacagccgtctgccgtcacagcggagcgcccctcagatccaagggacgctgcacgagcgcaagagcaggttgttgagaaggggaatataatcatggatatcatgcagactagtgactcttcacatcatggaattgtagaaaatagcccctacagaattccatatgacagacatgcagaaggtggtcaacttggtgcttcatggtattttagtagaaaagaaatagaggagaattccctttccaggagagatggcattgatctgaagaaagagtcttatcttcgcaagtcatattgcacatttctgcaggatttggggatgagacttaaagtacctcaagtgacaattgctactgctatagtgttctgtcatcggttctttcttcgtcaatcgcatgccaaaaatgacagacggacaattgcaacagtatgcatgttcttggcgggaaaagttgaagaaacacccagacctctgaaggatgtcatacttctttcatatgagatcatccacaaaaaggatcctgctgcagttcaacgaataaaacagaaggaagtatatgaacaacaaaaggaacttattttactcggggaacgtgttgtgcttgtgacacttggttttgatttgaatgtgaaccatccttacaagcccttggttgaagcaataaaaatattcaaggttgctcaaaatgcacttgctcaagttgcctggaattttgtcaatgatgggctccgcacttcactttgcctgcaatttaaaccgcaccatattgcggctggtgcaatcttcctcgctgcgaagtttctcaaagtcaagcttccatcagatggcgagaagktctggtggcaagagtttgatgtaactccgtggcagctggaagaggttagcaaccagatgttggaactgtatgagcaaaaccgtgttcaaccaccaccatcacaaggcaatgatactgaaggcagttctgcaagtgttgcgaatcaacgtgttcctggtaaagttccaggagtagctgatgaacctcctgcccatgaccataaccaagcacccagaccatcgagccagcagaacatgctagaccaccgtggctatgaccaccctcacccagataagcaaaactataggatacctccaaatgatgcaagggatggcactgctaatagcaacgaaggtcccaatgtgtcgtcttcaatgatggatgcgatgaagaaggtaaacaaggataaggtgaaagcggcactggagaagcgtaggaaatcgaaaggtgatttttcaagaaaggtcgatgtgatggatgacgatgacctcattgagagggagctagaacatggcgtggagttggctgccgaggatgagaaggtcaagcaggagagaaagcagagctggcctcatcttgcacaccaccagagcaccaaccgtgagaataccgaagagggtgagctgtccatggacagtcaagaataccgttctccggagcatgacaatcggaagagaaaggatgtgcgtgagtaccggaactacgatcgtgacgaaagggaccttaaaaggctaagatcatgagagttgcacttttgtcggagtctcatgttgttcgtgccataacatgatgtggaacctctatctttctgtcacaggtgtacttgatgcttatttggtatgctgggggatttgaactgttacatatataagtttataagatggtttccccacggtcatgtatgtgtttagccatgttggcaattgagatggcgctgtgccttgagtattccacaggtttatgctggaaacaacatttaaggaagctgcgtcctacgggtatctgaaatgtatgtattttgattcc

SEQ ID NO: 558 - protein, 487 aa, Zea mays
  misc_feature: Ceres CLONE ID NO.354421
  misc_feature (34)..(178): Pfam Name: Cyclin_N Pfam Description: Cyclin, N-terminal domain
  misc_feature (1)..(487): Functional Homolog of  Ceres CLONE NO.33877 at SEQ ID NO.556 with e-value of 2.90E-60 and BLAST sequence identity of 54.3
  misc_feature (248)..(248): Xaa is any aa, unknown, or other
MDIMQTSDSSHHGIVENSPYRIPYDRHAEGGQLGASWYFSRKEIEENSLSRRDGIDLKKESYLRKSYCTFLQDLGMRLKVPQVTIATAIVFCHRFFLRQSHAKNDRRTIATVCMFLAGKVEETPRPLKDVILLSYEIIHKKDPAAVQRIKQKEVYEQQKELILLGERVVLVTLGFDLNVNHPYKPLVEAIKIFKVAQNALAQVAWNFVNDGLRTSLCLQFKPHHIAAGAIFLAAKFLKVKLPSDGEKXWWQEFDVTPWQLEEVSNQMLELYEQNRVQPPPSQGNDTEGSSASVANQRVPGKVPGVADEPPAHDHNQAPRPSSQQNMLDHRGYDHPHPDKQNYRIPPNDARDGTANSNEGPNVSSSMMDAMKKVNKDKVKAALEKRRKSKGDFSRKVDVMDDDDLIERELEHGVELAAEDEKVKQERKQSWPHLAHHQSTNRENTEEGELSMDSQEYRSPEHDNRKRKDVREYRNYDRDERDLKRLRS

SEQ ID NO: 559 - DNA, 1281 bp, Populus balsamifera subsp. trichocarpa
  misc_feature: Ceres ANNOT ID no.1442675
  misc_feature: Encodes the peptide sequence at SEQ ID NO 560
atggctaggattgcaactagcatgcacttgccgaaggagcctcagtatcatacacgcaagtggtacttcagtagacaagaaattgaagatttttccccttctagaagggatggtattgacgttgagaaggagtctcaattacggaaattgtactgttcatttattaaagagctcggcgtgaagcttaaagtgccccaggtgacaatagcatgtgcattgatattgtgccaccggttttacatgcgtcaatctcatgcaaagaatgattggaagacaatggcatctgcaagcatgtttcttgcttgcaaactggaggaaactccgcgcttgctgagggatgttgttgttgtggcttatgagctgatgcacaaaagggatccttctgcctcacatagaatcaggcagataggattttgcagtagtcagaaggaattgcttgtaactggagagaggcttttattggcaacaattggttttgatcttgatgtccaacttccttacaagccacttgtaaatgctttgaagaaattgaacatatacccagatcttgcaaaagtagcttggaattttgtgaatgattggctttgcacaactttatgcttgcagtacaagccccattacattgcagctggttccatgtatctcgctgccaaatttcaaaaggtgaaacttcctacagagaagggaaatgtctggtggctggagtttgacatttcacctaaacaattagaagaggtcatccaacagatggccaggttgttagagcaagatccaaaaaggactcttccggcaacgcatgggagggttccacaatctaaagcttctgccaagaagatggttaccagtagtgcgcaatcagctgttacaagtgtatcaatgtctaattcacttgctagcgatggggctgtgatggaagcttcatcctcatctgacagaaacaccagcctgaatgaagttttaccatgtcaaacaattgatagtggtgcaagcagtgttgttgaggatggtgatggtaagaatcagccaagaacaggggactatgagttgagctccagcagcaatattgccccatcttataattcccatcataacattgatgtccaccagattagagagacattaaagagacggagatgccagatagctgcaaaaagtagagcttcattgtccaatgaaaccatggatgctgagttagatacggaaacctggatagaaagggagctagaagaagggatagagttgcaaactgctccttcagagaagaaacgaaggaaggtgtga

SEQ ID NO: 560 - protein, 426 aa, Populus balsamifera subsp. trichocarpa
  misc_feature: Ceres ANNOT ID NO.1442675
  misc_feature (18)..(162): Pfam Name: Cyclin_N Pfam Description: Cyclin, N-terminal domain
  misc_feature (1)..(426): Functional Homolog of  Ceres CLONE NO.33877 at SEQ ID NO.556 with e-value of 2.20E-78 and BLAST sequence identity of 57.5
MARIATSMHLPKEPQYHTRKWYFSRQEIEDFSPSRRDGIDVEKESQLRKLYCSFIKELGVKLKVPQVTIACALILCHRFYMRQSHAKNDWKTMASASMFLACKLEETPRLLRDVVVVAYELMHKRDPSASHRIRQIGFCSSQKELLVTGERLLLATIGFDLDVQLPYKPLVNALKKLNIYPDLAKVAWNFVNDWLCTTLCLQYKPHYIAAGSMYLAAKFQKVKLPTEKGNVWWLEFDISPKQLEEVIQQMARLLEQDPKRTLPATHGRVPQSKASAKKMVTSSAQSAVTSVSMSNSLASDGAVMEASSSSDRNTSLNEVLPCQTIDSGASSVVEDGDGKNQPRTGDYELSSSSNIAPSYNSHHNIDVHQIRETLKRRRCQIAAKSRASLSNETMDAELDTETWIERELEEGIELQTAPSEKKRRKV

SEQ ID NO: 561 - DNA, 1738 bp, Zea mays
  misc_feature: Ceres CLONE ID no.354406
  misc_feature: Encodes the peptide sequence at SEQ ID NO 562
atgctcgggtccgatggttcccgtctccgacaccgcactgctcacaacttcgacaccacttccgactccgtcgccaggtccgccgccggcgagagcgccgcagtcgctagctccgtatgcagagtatacagctgcagcggcgggtgctcctgccggtaccgagtgagtgtgagacggcggaagctccacgtccagcggcgtgcccctccgtcttccgtcactccagatccgaggcagttcactgctgggacgcagtcagagctgttcggtggagctgacaggtttttgagaagaggaatataatcatggttatcatgcagagcagtgactcttcacataatggttcacataatggaattgtagaaaatagtccgtacagaattccatatgacagacatgcagaaggtgatcaacttggtgcttcatggtattttagtagaaaagaaatagaggagaattccgtatcgaggagggacggcattgatctgaagaaagagtcttatcttcgcaagtcatattgcacatttctgcaggatttggggatgaggcttaaagtgcctcaagtgacaattgctactgctatagtgttctgtcatcggttttttcttcgtcaatctcatgcgaaaaatgacagacggacaattgcaacagtatgtatgttcttggcgggaaaagttgaagaaacacccagacctctgaaggatgtcatacttctttcatacgagatcatccacaaaaaggatcctgctgcagttcaacgaataaaacataaggaagtatatgaacaacagaaggaacttattttacttggggaacgtgttgttcttgtaacacttggttttgattttaatgtgaaccatccttacaagcccttggttgaagcaataaaaaaatttgaggttgctcaaaatgcacttgcgcaagttgcctggaattttgtcaatgatgggctccgcacttcactttgcctgcaatttaaaccgcaccatattgcggctggcgcaatcttcctggctgcgaagtttcttaaagtcaagcttccatcagatggcgagaaggtctggtggcaagagtttgatgtaactccgcggcagttggaagaggttagcaaccagatgttggaactctatgagcagaaccgtgttcaaccaccaccatcacaaggtaatgatactgaaggcagttctgtaactgctgtgaatcaacgtgctctgggtaaagttccaggagtagttgatgaacctcctgcccatgaacataaccaagcaaccaggcaatcgagccagcagaacatgtcaggccaccatggctatgatcaccctcatccggagaagcgaaactatagggtacccccaaatgaagcaagggatgacagtgctaacagcagcgagggtcccaacgtgtcagcctcgatgatggatgcaatgaaaaagataaacaaggataaggtgaaagcggccctggagaagcggagatcaaaaggtgacctttcgatatgctctcaaataggatgttctgctcccctcttgtatttgtatgcaggaaagggtttgtagggagtttaccccccccccccccccccccgcctttcttttgggcaraaaracatattctggaagcctttcartakttcatttatcavcaacaattgcatctttcttccattgctgkgcaccttgtatcacctatcaaaatgtggtcatatggggattgtacggcavcactgctgkgtgtgttg

SEQ ID NO: 562 - protein, 416 aa, Zea mays
  misc_feature: Ceres CLONE ID NO.354406
  misc_feature (38)..(182): Pfam Name: Cyclin_N Pfam Description: Cyclin, N-terminal domain
  misc_feature (1)..(416): Functional Homolog of  Ceres CLONE NO.33877 at SEQ ID NO.556 with e-value of 1.49E-61 and BLAST sequence identity of 54.3
MVIMQSSDSSHNGSHNGIVENSPYRIPYDRHAEGDQLGASWYFSRKEIEENSVSRRDGIDLKKESYLRKSYCTFLQDLGMRLKVPQVTIATAIVFCHRFFLRQSHAKNDRRTIATVCMFLAGKVEETPRPLKDVILLSYEIIHKKDPAAVQRIKHKEVYEQQKELILLGERVVLVTLGFDFNVNHPYKPLVEAIKKFEVAQNALAQVAWNFVNDGLRTSLCLQFKPHHIAAGAIFLAAKFLKVKLPSDGEKVWWQEFDVTPRQLEEVSNQMLELYEQNRVQPPPSQGNDTEGSSVTAVNQRALGKVPGVVDEPPAHEHNQATRQSSQQNMSGHHGYDHPHPEKRNYRVPPNEARDDSANSSEGPNVSASMMDAMKKINKDKVKAALEKRRSKGDLSICSQIGCSAPLLYLYAGKGL

SEQ ID NO: 563 - protein, 543 aa, Oryza sativa subsp. japonica
  misc_feature: Public GI ID NO.77555729
  misc_feature (33)..(177): Pfam Name: Cyclin_N Pfam Description: Cyclin, N-terminal domain
  misc_feature (1)..(543): Functional Homolog of  Ceres CLONE NO.33877 at SEQ ID NO.556 and an e-value of 1.60e-62 BLAST sequence identity of 55.7
MAMMPSDSSHHGIVENSPYRTTQGRNEETGELGASWYFSRKEIEENSPSRRDGIDLKKESYLRKSYCTFLQDLGMRLKVPQVTIATAIVFCHRFYLRQSHAKNDRRTIATVCMFLAGKVEETPRPLKDVILVSYEIIHKKDPAAGQRIKQKEVYDQQKELILLAERVVLATLGFDLNVHHPYKPLVEAIRKFKVAQNALAQVAWNFVNDGLRTSLCLQFKPHHIAAGAIFLAAKFLKVKLPSDGEKVWWQEFDVTPRQLEEVSNQMLELYEQNCAAQAQPSHGNEAEGSSASVPNQRVSVKSEETPLPHQSKQSSSQHSTGAPSHHGVEHSNLEKQTVDQKMLQNDNGDHGSNKTRSNQSGSRVDFGANDGLHHDKQSMTENKNLPSHGNSSEIRDVNRNGNDGTNVTSLMVNKIDKDKVKAQMEKQRKLKGDVARKVEVIDDDDDLERQLEHDIELAVEDNKIKQERKQSSPHVMHRGDHRNADQVTGNGHLGKQNTPETAQDAPMDDIKEQRNSHGSKHHDSHDTAHERGERDYKRPRPEG

SEQ ID NO: 564 - DNA, 690 bp, Arabidopsis thaliana
  misc_feature: Ceres CLONE ID no.101876
  misc_feature: Ceres LOCUS ID At3g03170
  misc_feature: Encodes the peptide sequence at SEQ ID NO 565
aaaaataattatagtcgtataaatgccactgttctctcaactcttaatcaattagaagccgcttagaagaaaaaatgcactatcaagaacagatggagtctcttatgttgggtgaagaacgcagacgcggaaactacaccagagacgtagacgcggactcagatgaaggtgttaactctccctcttcttttccaaactcccctgatgattcggaccgtcgcagttcttcttcttcttcaaggagaggattgtcgaaacattacaaaggtaaatcacaatcgttcacaacgttggcagaagcgctaactgtggaagatctcgcgaasctgagaatccattcaacgcaaagctgaagcagcgacgagagagccctcactgtcgtagattatcaggatgcggcggcgcatcggagcgaaatttaagtgtccacgacgtttttctcgctgggaacgatagaccgccgcgactttccggtaacagaccgcctccgagagcccagacgctctcsgcggctcatatttcggctttgctcactcgaacctaaaccggaagagaaccgggtttcgtttgggacgatgtttttcaaatcttttgttttctaatcttgtacaagttgttgttactttaaagtgttttgactcttttgataattttgtaagtttcagtttaatttagagagcacttaacagt

SEQ ID NO: 565 - protein, 156 aa, Arabidopsis thaliana
  misc_feature: Ceres CLONE ID NO.101876
  misc_feature: Ceres LOCUS ID At3g03170
MHYQEQMESLMLGEERRRGNYTRDVDADSDEGVNSPSSFPNSPDDSDRRSSSSSSRRGLSKHYKGKSQSFTTLAEALTVEDLAKPENPFNAKLKQRRESPHCRRLSGCGGASERNLSVHDVFLAGNDRPPRLSGNRPPPRAQTLSAAHISALLTRT

SEQ ID NO: 566 - DNA, 780 bp, Triticum aestivum
  misc_feature: Ceres CLONE ID no.848588
  misc_feature: Encodes the peptide sequence at SEQ ID NO 567
tccaagctatcatcctgctagcacccgtgaactccagccattcacgctgcgtcgatcgtttggtttcgtgcgtgcgttgtttgtgatcgtgtgatctgttcgggagatggaggcttacatgctgttcccgcggagcaatggaaagagctgcgaggaggagcaggaggaggacatcggctgcccgtccgagtccgaggtgtcggcggccggctccatgctgtcgtcggacgaggagctcgacgacgacgccacctccagctccagctcctccggatccaccgacaacttccagatgtcctccctcatggcgcagctcccgctcaagaggggtctgtccaagttcttcgacggcaagtcgcagtcgttcgcgtcgctcgcggcggtgggcggcctggaggacctggccaagccgccgggcaagcggatcaagacgtcgcggagctgcgaggtcgggctgcaggacgcgcaccgccggcggttcgcgcgccacaatgccgcggccttcaagaaggtgtccaaagggcggctgtccgcgctcggcagggcgccgccgctccggccgctgacagcgagcgcggcgaggcccaagggcttgcccgtgcgggctccgctgttcgtttaggagatttcgcccgcagattagtcgtgtcggttgtggcgtgctcaaagagcagttggtgcggttgttacgtggattttgacatggtaactgaccggaaggtggccggctggtcgatggatgtgtaaatacagaaatgagaaacaaaaaaaaaaaaaaaa

SEQ ID NO: 567 - protein, 171 aa, Triticum aestivum
  misc_feature: Ceres CLONE ID NO.848588
  misc_feature (1)..(171): Functional Homolog of  Ceres CLONE NO.101876 at SEQ ID NO.565 with e-value of 2.30E-7 and BLAST sequence identity of 38.5
MEAYMLFPRSNGKSCEEEQEEDIGCPSESEVSAAGSMLSSDEELDDDATSSSSSSGSTDNFQMSSLMAQLPLKRGLSKFFDGKSQSFASLAAVGGLEDLAKPPGKRIKTSRSCEVGLQDAHRRRFARHNAAAFKKVSKGRLSALGRAPPLRPLTASAARPKGLPVRAPLFV

SEQ ID NO: 568 - DNA, 720 bp, Brassica napus
  misc_feature: Ceres CLONE ID no.947386
  misc_feature: Encodes the peptide sequence at SEQ ID NO 569
gtatataaaaagggcactgtttccatgctcaactcttgataaattataagcgcctttgaagagaagaaaaaaaaaatgcattatcaagaacagatggagtctcttatgttgggtgaagaacgcagacgcgaaaactgcgttagagacgcagacgcggacgcagatgaaggttttaactctccctcttcttttccaaactctcctgacgaatcagaccgtcgcagttcttcttcttcaaggagaggattgtcaaaacattacagaggcaagtcacagtccttcacgtcgctgtcggaagcgctgacagtagaagatctcgcgaaacccgagaatcctctcaacgcgaaactgaagcagcgacgggagagctctcactgtcgacgattatccggttgcggcggtgcatcgcagcaaaatctagctggccacgacgctttcttcgccggaaacgataggcagccgagactttccggtaacagactgcctccgagagctcagacgctttcggcggctcacatatcggctttgctcactcgaacctgaaccgggaagcttttagtttatttgtttatctaaaccggaatagaaccgggtttcgtttgggatgatgtttactggagcttcagtcttytgaattgtgtgagaatgtataaattataagtatttagactcttatgatcgtttcgaaattttcagtttaatctaaattagctcaagccg

SEQ ID NO: 569 - protein, 155 aa, Brassica napus
  misc_feature: Ceres CLONE ID NO.947386
  misc_feature (1)..(155): Functional Homolog of  Ceres CLONE NO.101876 at SEQ ID NO.565 with e-value of 6.40E-67 and BLAST sequence identity of 87.0
MHYQEQMESLMLGEERRRENCVRDADADADEGFNSPSSFPNSPDESDRRSSSSSRRGLSKHYRGKSQSFTSLSEALTVEDLAKPENPLNAKLKQRRESSHCRRLSGCGGASQQNLAGHDAFFAGNDRQPRLSGNRLPPRAQTLSAAHISALLTRT

SEQ ID NO: 570 - DNA, 414 bp, Brassica napus
  misc_feature: Ceres CLONE ID no.961460
  misc_feature: Encodes the peptide sequence at SEQ ID NO 571
aatatatataaaaagggcactgtttctatgctcaagtcttgataaattagaaggaagagaaaaaaaaatgcattatcaagaacagatggagtctcttatgttgggtgaagaacgcagacgcgaaaactgcgttagagacgcagacgcggacacagatgaaggttttaactctccctcttcttttccaaactctcctgacgaatcagaccgtcgcagttcttcttcttcaaggagaggattgtcaaaacattacagaggcaagtcacagtccttcacgtcgttgtcggaagcgctgacagtagaagatctcgcgaaacccgagaatcctctcaacgcaaagctgaagcagcgacgggagagctctcactgtcgacgattatccggttgcggcggtgcatcgcagcaaaatctagc

SEQ ID NO: 571 - protein, 115 aa, Brassica napus
  misc_feature: Ceres CLONE ID NO.961460
  misc_feature (1)..(115): Functional Homolog of  Ceres CLONE NO.101876 at SEQ ID NO.565 with e-value of 5.30e-49 and BLAST sequence identity of 87.8
MHYQEQMESLMLGEERRRENCVRDADADTDEGFNSPSSFPNSPDESDRRSSSSSRRGLSKHYRGKSQSFTSLSEALTVEDLAKPENPLNAKLKQRRESSHCRRLSGCGGASQQNL

SEQ ID NO: 572 - DNA, 680 bp, Parthenium argentatum
  misc_feature: Ceres CLONE ID no.1609830
  misc_feature: Encodes the peptide sequence at SEQ ID NO 573
atagcatgatggtgatgcatatgcagatgggttcttcttcattagatcaagaaaacaagatcgggttcatgggtcatgatgaagaagaagatgtatattcatcggatgcttcgagtgttgtgtcttcagatgatgaatctgaccatgatgactttgaacaaagtaattcttcatcggataacaatcatgcgttaggaagcatgtctgatctacttcaacaacttccttccaagagagggttatccaaacactttcaagggaaatcacaatcattcacatccttatcaaaagtgacatgtttagaagatcttgcaaagccagaaaacccttacaacaagaaaataaaatcatgcaaaagttacgcagcattatcaagagttcttccacctccaacacgaagcgcatcatcttcaaagctcttcacgaagacgtcgtcttcgagagcttcttgttcttcactaagcaatagcagcaggccaccaactcatccgtcccatagcaatggtgccacaagtggttctggtttctcaaatcaaacacctttgtttgtttgaggtaatcgtgtttgattcgattggtttgttgttggtatgtatggtcttggttctcggcttttaggatggtcgaaagagcgttttgtggaggatgttttcatggatcgtattcgtgtatttgagtta

SEQ ID NO: 573 - protein, 182 aa, Parthenium argentatum
  misc_feature: Ceres CLONE ID NO.1609830
  misc_feature (1)..(182): Functional Homolog of  Ceres CLONE NO.101876 at SEQ ID NO.565 with e-value of 7.29E-11 and BLAST sequence identity of 45.7
MMVMHMQMGSSSLDQENKIGFMGHDEEEDVYSSDASSVVSSDDESDHDDFEQSNSSSDNNHALGSMSDLLQQLPSKRGLSKHFQGKSQSFTSLSKVTCLEDLAKPENPYNKKIKSCKSYAALSRVLPPPTRSASSSKLFTKTSSSRASCSSLSNSSRPPTHPSHSNGATSGSGFSNQTPLFV

SEQ ID NO: 574 - DNA, 1048 bp, Arabidopsis thaliana
  misc_feature: Ceres CLONE ID no.156373
  misc_feature: Ceres LOCUS ID At3g11200
  misc_feature: Encodes the peptide sequence at SEQ ID NO 575
tttttaaaaaacttctccttcttgttccgtctgcttctctccatctccttccatatctattgttctctctctcttcatgcccgaacgcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagctcgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagctttc

SEQ ID NO: 575 - protein, 246 aa, Arabidopsis thaliana
  misc_feature: Ceres CLONE ID NO.156373
  misc_feature: Ceres LOCUS ID At3g11200
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 576 - DNA, 714 bp, Populus balsamifera subsp. trichocarpa
  misc_feature: Ceres ANNOT ID no.1511533
  misc_feature: Encodes the peptide sequence at SEQ ID NO 577
atggcttccatactcacaagccctcgcactgtagaagagatcttcaaagattacagcgctcgtcgctctgccctcgttcgtgctctcactatcgaagccgatgaagtttacattcaatgcgatccagaaaaagaaaatctgtgcttgtatggacatccaactgagtcctgggaggtgaccctgccagctgaggaagttcccccggagctccctgagcctgctttgggcattaattttgccagggatgggatgagtcgtaaagattggctctctcttgtggctgtccatagtgactgttggttgctttccatggcattctactttggtgcacgacttaatcgcaacgacaggaagcgattgtttagcatgataaatgatctgcccaccctctttgaaattgtaactgggaggaaaccagcagaagacaaacctagtgcagaaagcggcagcaaatccaggaataacacaaagagatcaatagatggacaggcgagaagtaattccaagttaagttatgtggaggatgaagacgagcatggagacaccatttgtgggagctgtgcagggaactacaatgccgatgagttttggattggttgtgacatctgtgaacgatggtaccatggaaaatgtgtgaagataacaccagcaaaagcagaaagtatcaagcagtacaaatgcccttcttgcagcacaaagaagtccaggcactaa

SEQ ID NO: 577 - protein, 237 aa, Populus balsamifera subsp. trichocarpa
  misc_feature: Ceres ANNOT ID NO.1511533
  misc_feature (183)..(233): Pfam Name: PHD Pfam Description: PHD-finger
  misc_feature (1)..(237): Functional Homolog of  Ceres CLONE NO.156373 at SEQ ID NO.575 with e-value of 1.59E-102 and BLAST sequence identity of 80.4
MASILTSPRTVEEIFKDYSARRSALVRALTIEADEVYIQCDPEKENLCLYGHPTESWEVTLPAEEVPPELPEPALGINFARDGMSRKDWLSLVAVHSDCWLLSMAFYFGARLNRNDRKRLFSMINDLPTLFEIVTGRKPAEDKPSAESGSKSRNNTKRSIDGQARSNSKLSYVEDEDEHGDTICGSCAGNYNADEFWIGCDICERWYHGKCVKITPAKAESIKQYKCPSCSTKKSRH

SEQ ID NO: 578 - DNA, 702 bp, Populus balsamifera subsp. trichocarpa
  misc_feature: Ceres ANNOT ID no.1518013
  misc_feature: Encodes the peptide sequence at SEQ ID NO 579
atggcgtcccctcgcactgtagaagagatcttcaaagattacaacgcccgtcgctctgccctcgttcgcgctctcactattgaggctgatgaagtctaccttcaatgcgatccagaaaaagagaatttgtgtctgtatggacatccaaacgagtcctgggaagtgactctgccagcagaggaagttccgccagagctccctgagccggcgttgggcattaattttgccagagatggaatgacgcgtaaagactggctttctcttgttgctgtgcacagtgacagttggttgctttcagtgggattctactttggtgcacgacttaatcgcaacgaaaggaagcgactgtttagcatggtaaatgatctgcccaccctctttgaaattgtgaccgggaggaaaccagtagaagataagcctagtgctgacggtggtagcaaatccaggaataacacaaagagatcaactgatggacaggcaagaagcaattccaagttaagttacgtggaggatgaagatgagcatggggacaccctttgcgggagctgtggagggaactacaatgctgatgagttttggattggttgtgacatttgtgaacgatggtaccatggaaagtgtgtgaagataacaccagcaaaagctgaaagcatcaagcagtacaaatgcccttcttgcagcacaaagaaatctaggcactaa

SEQ ID NO: 579 - protein, 233 aa, Populus balsamifera subsp. trichocarpa
  misc_feature: Ceres ANNOT ID NO.1518013
  misc_feature (1)..(233): Functional Homolog of  Ceres CLONE NO.156373 at SEQ ID NO.575 with e-value of 5.40E-102 and BLAST sequence identity of 81.8
MASPRTVEEIFKDYNARRSALVRALTIEADEVYLQCDPEKENLCLYGHPNESWEVTLPAEEVPPELPEPALGINFARDGMTRKDWLSLVAVHSDSWLLSVGFYFGARLNRNERKRLFSMVNDLPTLFEIVTGRKPVEDKPSADGGSKSRNNTKRSTDGQARSNSKLSYVEDEDEHGDTLCGSCGGNYNADEFWIGCDICERWYHGKCVKITPAKAESIKQYKCPSCSTKKSRH

SEQ ID NO: 580 - DNA, 1111 bp, Glycine max
  misc_feature: Ceres CLONE ID no.477995
  misc_feature: Encodes the peptide sequence at SEQ ID NO 581
gctgtctgtcgttctatttaattcccctctccaaatttcaacctctgtctcctctccttaacagcatcatcacatgcacccgcgattcctacgatcccttcccatggtctcttctctgcaccctcgccgtaccttctagaaccttccctcagatctcaattccccttccgctttctcctttcatggaaatggcttccactccccgcaccgtcgaagagatcttcaaggactacaccgcccgcagaaccgccatcgttcgcgctctctctcaagatgtggatgaattctacggactctgcgatccagataaggagaacttgtgcctctatggacatccgaatgaaacatgggaggtgactttgccggcagaggaagttcctccggagcttccggagcctgcactcggaatcaattttgctagggatggcatgaaccgcagggactggctttctctggttgctgtgcacagtgattcgtggttgctctctgtggccttctatcttggagctcgtcttaaccgcaacgaaaggaaacgtttatttagcttgatcaatgatcttcctactgtttttgaagttgtgactgagaggaagccagtaaaggacaagcccactgcagacagtggaagcaagtctagaggcagcaccaagagatcaagtgatgggcaagttaagagcaacccaaagtttgcagatgatggttatgaagacgaggatgatgagcacagtgaaaccctttgtgggagctgtggcggaaattacaatgcagatgaattttggattggctgcgatatatgtgagaggtggttccatgggaaatgtgtgaagatcactcctgcaaaagctgagagcataaagcaatacaaatgtccatcatgcagcttgaggcgaggcaggccctaagccgaaggcaaaatgtgaagtgaataatgctgtttcatggccgacaaagatactgtaatattgttgtatcttttatagaagttcttgtaaacggtatagtatctatgtctgatcataatctttcagattaagttaatttcttctaccaagattaatcatcagtgtatgttatataattttatagaatagaattctatacattttatttt

SEQ ID NO: 581 - protein, 239 aa, Glycine max
  misc_feature: Ceres CLONE ID NO.477995
  misc_feature (1)..(239): Functional Homolog of  Ceres CLONE NO.156373 at SEQ ID NO.575 with e-value of 1.80E-101 and BLAST sequence identity of 77.5
MEMASTPRTVEEIFKDYTARRTAIVRALSQDVDEFYGLCDPDKENLCLYGHPNETWEVTLPAEEVPPELPEPALGINFARDGMNRRDWLSLVAVHSDSWLLSVAFYLGARLNRNERKRLFSLINDLPTVFEVVTERKPVKDKPTADSGSKSRGSTKRSSDGQVKSNPKFADDGYEDEDDEHSETLCGSCGGNYNADEFWIGCDICERWFHGKCVKITPAKAESIKQYKCPSCSLRRGRP

SEQ ID NO: 582 - DNA, 1139 bp, Zea mays
  misc_feature: Ceres CLONE ID no.486840
  misc_feature: Encodes the peptide sequence at SEQ ID NO 583
gtgtaaatagaagataggcgacgaacacgaagcaagcaaggcagccgaatcccaactcctgtgtgtgcctgccaacgcctcgtcggccgccgccgccgctgcttcgcccctctccgccagccgctcccgctcggagcacgccgccgccgacgtgggcgcgcaccgacggccgtcgtgtcgcatggatatggcccccgcggccgtctcctccaacccgcgctcggtcgaggaaatcttcaaagacttctccggtcggcgcgcggggctcgtccgcgccctcacctccgatgtggacgatttctgcagcttctgcgacccagataaggagaacttgtgtctctacggccttcccaacggtagctgggaggtctcgccgccggcggacgaggttcctccggagttgcccgagccggcgctcggcatcaactttgcgcgcgacggcatgcagcgccgcgactggctctcactcgtcgcggtccactctgactcgtggctcatctcagtcgccttcttctacggcgcccgcctcaacgccaacgaccggaagcgcttattcagcatgatcagtgatcttccttctgtctttgaagcatttgcggacaggaaacacgtcagggataggtctggcgttgatagcagcggcaagtccaggcactcatcaaagagaggaaacgatggccatgcgaagaactccagggcagcagctcctgctgccaaagagtacgacgacgacgatgacgaggaggacgaggaacacacggaaaccttttgtggaagctgcggcggcctctacaacgcgaacgagttctggatcggctgcgacatctgcgagcggtggttccacggcaagtgcgtgcggatcacccctgccaaagcggaccacataaagcactacaagtgcccggactgcagctcgaagaaaataaggcagtaggtcccagtgtgcaccgccggccatcgctgacctgtctgatcccaaaccatactccattgcttgcctgccttgccccaaggtcgcagttatcagatgcgcattccttcatttgtggggggttgttgtgtgatggatagcctggtaggaagaggcaaaggactgatatataatgactcgtttattgttcaaaaaaaaaaaaaaaaaa

SEQ ID NO: 583 - protein, 248 aa, Zea mays
  misc_feature: Ceres CLONE ID NO.486840
  misc_feature (194)..(244): Pfam Name: PHD Pfam Description: PHD-finger
  misc_feature (1)..(248): Functional Homolog of  Ceres CLONE NO.156373 at SEQ ID NO.575 with e-value of 1.09E-89 and BLAST sequence identity of 67.7
MAPAAVSSNPRSVEEIFKDFSGRRAGLVRALTSDVDDFCSFCDPDKENLCLYGLPNGSWEVSPPADEVPPELPEPALGINFARDGMQRRDWLSLVAVHSDSWLISVAFFYGARLNANDRKRLFSMISDLPSVFEAFADRKHVRDRSGVDSSGKSRHSSKRGNDGHAKNSRAAAPAAKEYDDDDDEEDEEHTETFCGSCGGLYNANEFWIGCDICERWFHGKCVRITPAKADHIKHYKCPDCSSKKIRQ

SEQ ID NO: 584 - DNA, 1173 bp, Glycine max
  misc_feature: Ceres CLONE ID no.525628
  misc_feature: Encodes the peptide sequence at SEQ ID NO 585
agtttattttttctctctttgatcaaattcccttcccatggtctctctctcttcaattaattccatttagctttccccaaatcccaaaccctttttcgcttagatcccaatccaattgggttatggacatggcttccagtccccgcactgtagaagagatcttcaaggattacagcgccagaagaacctctgttattcgcgctctcactcacgacgttgatgaattttacggcctctgtgatccagataaggataacctgtgcctctatggacatccaaatgaggcctgggaagtaactctgccagcggaggaagttccgccagagctcccggagccggctcttggaatcaattttgctagggatggcatgaaccgcagggactggctttctctggttgctgtccacagtgattcatggttggtttctgtggccttttaccttggggctcgtcttaaccgcaatgaaaggaaacgattatttagcttgatcaatgatcttccatctgtttttgaagttgtgactgacaggaaaccagttaaggacaagccaactgcggatagtggaagcaagtctaggggaagtgccaagagatctagcgatgggcaagttaaaagcaacccaaagtttgtagatgagggttatgaggaggatgaagatgagcataatgaaacactttgtggaagctgcggcggaaattacaacgctgatgagttttggatttgctgtgacatatgtgagaggtggttccatgggaagtgtgttaagattacccctgcaaaggctgagagcataaagcaatataaatgtccatcatgcagcctgaggcggggcaggccttagactgaaagaggcgatggaatgggtacatgtgaggtgagtgttgtttcatggctgacaagatactgtaattttgttacatcacttacagaagttaatgtaatgggcatagtatcgatgctcaagggcaaatttatcagggattaagtttgtttttccagatgaaccattggtgcatgccacagggtatagaatagaacatgacaaattttaattttatgattagtttatatttagtagaatatttgcttgaactttaaatattgtaatttttttatttttaacattgtttaagaaaacaaaccttttcaacaagaaaaaaaaaaaaaaaaaa

SEQ ID NO: 585 - protein, 239 aa, Glycine max
  misc_feature: Ceres CLONE ID NO.525628
  misc_feature (185)..(235): Pfam Name: PHD Pfam Description: PHD-finger
  misc_feature (1)..(239): Functional Homolog of  Ceres CLONE NO.156373 at SEQ ID NO.575 with e-value of 1.60e-102 and BLAST sequence identity of 77.5
MDMASSPRTVEEIFKDYSARRTSVIRALTHDVDEFYGLCDPDKDNLCLYGHPNEAWEVTLPAEEVPPELPEPALGINFARDGMNRRDWLSLVAVHSDSWLVSVAFYLGARLNRNERKRLFSLINDLPSVFEVVTDRKPVKDKPTADSGSKSRGSAKRSSDGQVKSNPKFVDEGYEEDEDEHNETLCGSCGGNYNADEFWICCDICERWFHGKCVKITPAKAESIKQYKCPSCSLRRGRP

SEQ ID NO: 586 - DNA, 1262 bp, Glycine max
  misc_feature: Ceres CLONE ID no.1170863
  misc_feature: Encodes the peptide sequence at SEQ ID NO 587
acttatacacattctattcttcaacaaacattgtagtttgatcaaattcccatggtctctctctctccaattaattcgatttagcttttccccaaatcccaaaccctttctttcgcttagatcccaatccaattgggttatggacatggcttccagtccccgcaccgttgaagagatcttcaaggattacggcgccagaagaactgccgttattcgcgctctcactcacgacgttgatgaattttacggcctctgtgatccagataaggataacctgtgcctctatggacatccaaatgaggcctgggaagtaactctgccagcggaggaagttccgccagagctccctgagcctgctcttggaatcaattttgctagggatggcatgaaccgcagggactggctttctcttgttgctgtgcacagtgattcgtggttggtttctgtggccttttacctcggggctcgtcttaaccgcaatgaaaggaaacgtttatttagcttgatcaatgatcttccatctgtttttgaagttgtgactgacaggaaaccagttaaggacaagccaactgcagatagtggaagcaagtctaggggaagtgccaagagatctagtgatgagcaagttaaaagcaacccaaagtttgtagatgagggttatgaggaggatgaagatgagcataatgaaacactttgtggaagctgtggcggaaattacaatgctgatgagttttggatttgctgtgacatatgtgagaggtggttccatgggaagtgtgttaagattacccctgcaaaggctgagagcataaagcaatataaatgtccatcatgcagcctgaggcggggcaggccatagactgaaggtgatggaatgggtacatgtgaggtgagtgttgtttcgtggttgacaagatactgtaactttgttacatcacttacagaagttcatgtaatgggcatagtattgatgcttaagggcaaatttatcagggattaagtttgtttttaccagatgaacgttgatggatgttacagagtatagaatagagcatggcaaattttaatttgatgattagtttatatttagttgaatatttgcttgaacttacatattgtaatttatttatttatttttaacattgtttaagaagacaaaaccttttcccctccacagattcttctaatcaaactttcattatgctgcttgatgggttaatgaaaagattatgtgagtggattcttgaaaaaaaaaaaaaaaa

SEQ ID NO: 587 - protein, 239 aa, Glycine max
  misc_feature: Ceres CLONE ID NO.1170863
  misc_feature (185)..(235): Pfam Name: PHD Pfam Description: PHD-finger
  misc_feature (1)..(239): Functional Homolog of  Ceres CLONE NO.156373 at SEQ ID NO.575 with e-value of 1.80E-101 and BLAST sequence identity of 77.1
MDMASSPRTVEEIFKDYGARRTAVIRALTHDVDEFYGLCDPDKDNLCLYGHPNEAWEVTLPAEEVPPELPEPALGINFARDGMNRRDWLSLVAVHSDSWLVSVAFYLGARLNRNERKRLFSLINDLPSVFEVVTDRKPVKDKPTADSGSKSRGSAKRSSDEQVKSNPKFVDEGYEEDEDEHNETLCGSCGGNYNADEFWICCDICERWFHGKCVKITPAKAESIKQYKCPSCSLRRGRP

SEQ ID NO: 588 - DNA, 1142 bp, Zea mays
  misc_feature: Ceres CLONE ID no.1393778
  misc_feature: Encodes the peptide sequence at SEQ ID NO 589
cttatgtttatgtcttcttcttctctccatctccttccaaagtctctctctctctctatcgcctttctctctctctctctctccacttccgaccacatcgggtctcagaaacccattgatgcggacctcgatctttctccactagctacagatctacacccttacacaaaccgtatatacatacacactttgtatctctctgtaaaatctatggccgccgtctcctctaaccctcgcaccgtcgaagagatcttcaaggattacaccgctcgtcgctccgccctcctccgtgctctaactaaagatgttgatgatttctactctcaatgcgatccggagaaggagaatttgtgtttgtatggacatccgaatgagtcgtgggaagtgaatctaccggcggaggaagttcctcctgagcttccggagcctgcgcttggtattaatttcgctagagatggtatgcagaggaaggattggctctcgcttgttgctgttcatagtgattgttggttgctctctgtttctttctactttggtgctcgccttaaccgcaacgagaggaagcggttgttcagtctgatcaacgatctcccaactctcttcgatgtagtgactggtaggaaacccatcaaagacaacaagccaagctcagattctggaagcaaatccagaaacggcactaagagatcaatagaagggcagacaaagagtccaacaccaagaccgatggaagagagctacgaggacgaggaagaagaagaagacgagcacggagacactctctgcggtatctgtggaggcaattatacgcaagatgagttctggatttgctgtgatgtttgtgaacgttggtaccatggaaaatgcgtgaagatcacccctgccaaagcagacagcatcaagcagtataaatgccctccttgctgtgcaaagaaaggaagacagtgattatgatcatcatcatcatcatcatctcccagagagactggttctcatgtcttaatattaatcatcctttttcttgtttcattaaccttttaatttcaaagcatacaaaaactctctctttagatcaccggaaagggattccaagaagttgagagagtgtagcaactgtttgagtatttttattcatataagag

SEQ ID NO: 589 - protein, 245 aa, Zea mays
  misc_feature: Ceres CLONE ID NO.1393778
  misc_feature (191)..(241): Pfam Name: PHD Pfam Description: PHD-finger
  misc_feature (1)..(245): Functional Homolog of  Ceres CLONE NO.156373 at SEQ ID NO.575 with e-value of 4.09E-127 and BLAST sequence identity of 94.6
MAAVSSNPRTVEEIFKDYTARRSALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKPIKDNKPSSDSGSKSRNGTKRSIEGQTKSPTPRPMEESYEDEEEEEDEHGDTLCGICGGNYTQDEFWICCDVCERWYHGKCVKITPAKADSIKQYKCPPCCAKKGRQ

SEQ ID NO: 590 - DNA, 1094 bp, Panicum virgatum
  misc_feature: Ceres CLONE ID no.1826835
  misc_feature: Encodes the peptide sequence at SEQ ID NO 591
aactcctgtgtgccccgtcggccgcagcagctgcccgtccccgccgcctccggccgagcacgccgccgccaccgcctccggccgagcacgccgccgccaccgcctccggccgagcacgccgccgccaccgccggcgagggcgcgcgtcgacggcccgtccctttcgcatggatatgacccccgcgtccgtctcgtccaacccgcgctcggtcgaggaaatctacaaggacttctccggccgccgcgccggcctcgtccgcgccctcacctccgatgtggacgatttctacagctcctgcgacccagataaggagaatttgtgcctgtacggcctccccagcgggacctgggcggtggcgccgccagcggaggaggtgccgccggagatgccggagccggcgctcggtatcaacttcgcgcgggacggcatgcaacgccgggactggctctcactcgtcgcagtccactccgactcgtggctcatttccgtcgccttcttcttcggcgcacgcctcaacgccaacgatcggaagcgcttattcagtatggtcagtgatcttccatccgtctttgaagcattctcagacaggaaacacggcagagataggtctggcgttgatagcagcggcaagtctagacactcgtcaaagagaggaagcgacggccacgtgaagaattctagagcagcagctcctgctgccaaacagtacgatgatgatgatgacgaagacgacgaggagcacaccgagaccttttgcgggacctgcggtggcctgtacaattcgaacgagttctggatcggctgcgacatctgcgagaggtggttccatggcaagtgcgtgcggattacccccgctcgagcggaccacataaagcactacaagtgcccggactgcagctcgaagaaaatgaggcagtagtagtgggggggcgtctgatctgatcaaaaccatactcctgttgtctgtccgcagctagcagatgtgaattcgttttagaaacgttgttgtggtgttgtgtggtggtgataggaagaggcagaggacagaatagatacatgctcgttgctcgttcaaaaaaaaaaaaaaaaaaaa

SEQ ID NO: 591 - protein, 248 aa, Panicum virgatum
  misc_feature: Ceres CLONE ID NO.1826835
  misc_feature (194)..(244): Pfam Name: PHD Pfam Description: PHD-finger
  misc_feature (1)..(248): Functional Homolog of  Ceres CLONE NO.156373 at SEQ ID NO.575 with e-value of 2.29E-87 and BLAST sequence identity of 64.0
MTPASVSSNPRSVEEIYKDFSGRRAGLVRALTSDVDDFYSSCDPDKENLCLYGLPSGTWAVAPPAEEVPPEMPEPALGINFARDGMQRRDWLSLVAVHSDSWLISVAFFFGARLNANDRKRLFSMVSDLPSVFEAFSDRKHGRDRSGVDSSGKSRHSSKRGSDGHVKNSRAAAPAAKQYDDDDDEDDEEHTETFCGTCGGLYNSNEFWIGCDICERWFHGKCVRITPARADHIKHYKCPDCSSKKMRQ

SEQ ID NO: 592 - DNA, 1092 bp, Gossypium hirsutum
  misc_feature: Ceres CLONE ID no.1834120
  misc_feature: Encodes the peptide sequence at SEQ ID NO 593
aaaagagtaccaatggcatattgcttgccatttgtataacatagagaaaaagaaatttattaggccattaattccaatccatggcttcctctgctcgaaccgttgaggaaatcttcaaagattacactgctcgaagaaccgccatccttcgtgctttaactttggatgtagatcacttttatggactctgtggtccagatagagagaatttatgcctttatgggcatccgaatgaaagctgggaagttagtctgccagcagaagaagttccagcagagcttcctgagcccgcccttggtatcaatttcgctagagatggaatgaaccgtaaagattggttgtccttggttgctgtccatagtgattcctggttgatttccctcgctttctaccttgctgctcgtcttaaccgtaatgaaaggaaacgtctatttagtatgatgaacgatctgcctacagtctttgaggttgtaactgaaaggaaacctgttaaagataaaccaagtatagagagtgggagcaaatctcagggcagcactaagagatcgagtgatggacaagtgaaaagcaatcctaagattgctgatgcggattacgaggataatgaagatgaacacggagaaacactatgcggtagctgcggtggaaatttcaatgcggatgagttttggattgggtgtgatgtttgtgagaggtggttccatggaaaatgtgttaaaataacaccagctaaagctgagagcattaagcagtataaatgcccatcttgcagcatgaggagcggcaggcactgatagtcggaaatggtaagaacaggacatgatccatctcaatggctgacaaagtagtatagcaaatactcgtgttaggtaactaatgtttgaagtttatatcatcaaaatgtaagtttatgatagatgatttgaagtcaatggaagttctacttccttactgatacctttatttgcattcaactcattagaatttgttaatttgtagcaatttgtccgtacgctggcacattgaggtggtcttttagacctaagagatcgattgaatttaaaacgttccgaaaaaaaaaaaaaaaaaaaa

SEQ ID NO: 593 - protein, 237 aa, Gossypium hirsutum
  misc_feature: Ceres CLONE ID NO.1834120
  misc_feature (183)..(233): Pfam Name: PHD Pfam Description: PHD-finger
  misc_feature (1)..(237): Functional Homolog of  Ceres CLONE NO.156373 at SEQ ID NO.575 with e-value of 6.49E-97 and BLAST sequence identity of 75.4
MASSARTVEEIFKDYTARRTAILRALTLDVDHFYGLCGPDRENLCLYGHPNESWEVSLPAEEVPAELPEPALGINFARDGMNRKDWLSLVAVHSDSWLISLAFYLAARLNRNERKRLFSMMNDLPTVFEVVTERKPVKDKPSIESGSKSQGSTKRSSDGQVKSNPKIADADYEDNEDEHGETLCGSCGGNFNADEFWIGCDVCERWFHGKCVKITPAKAESIKQYKCPSCSMRSGRH

SEQ ID NO: 594 - DNA, 698 bp, Gossypium hirsutum
  misc_feature: Ceres CLONE ID no.1930415
  misc_feature: Encodes the peptide sequence at SEQ ID NO 595
ataatacaatctttattttggagaaaaagaaaaaaaagtatggctttttctagtcctcgcactgtggaagagatcttcaaagactatagcgctcgacgctccggtcttgttcgtgctctcacttacgatgtagatgatttctactcgcaatgcgatccagataaggagaatttgtgtctgtatggacacccaaatgaggcttgggaggtagctttaccagcagaggaagttccacctgagctccctgagccagccttgggtatcaattttgctagagatgggatgaaccggaaagactggctttcactggttgctgtgcatagtgattgttggttgctttccgtgtctttctactttggagctcggcttaatcgcaatgaaaggaagcgcttatttagcatgataaacgatcttccaactgtctttgaagttgtaactggaaggaagcccataaaagacaagcccacagtagaaagtggaagcaaatcgcgaaacagcacgaagagatcaattgatggacagccaagaagcaatcctaagttagttgatgaaaattatgaggaggatgaagaagagcagggcgataccttttgcgggatttgtggtggaggatacaattctgatgagttttggatcggttgtgacaactgtgaacggtggtaccatggaaagtgcgtgaagataacaccagccaaggc

SEQ ID NO: 595 - protein, 237 aa, Gossypium hirsutum
  misc_feature: Ceres CLONE ID NO.1930415
  misc_feature (1)..(237): Functional Homolog of  Ceres CLONE NO.156373 at SEQ ID NO.575 with e-value of 1.19E-104 and BLAST sequence identity of 83.3
MAFSSPRTVEEIFKDYSARRSGLVRALTYDVDDFYSQCDPDKENLCLYGHPNEAWEVALPAEEVPPELPEPALGINFARDGMNRKDWLSLVAVHSDCWLLSVSFYFGARLNRNERKRLFSMINDLPTVFEVVTGRKPIKDKPTVESGSKSRNSTKRSIDGQPRSNPKLVDENYEEDEEEQGDTFCGICGGGYNSDEFWIGCDNCERWYHGKCVKITPAKAELIKFYKCPLCTKKARQ

SEQ ID NO: 596 - protein, 257 aa, Medicago sativa
  misc_feature: Public GI ID NO.12651665
  misc_feature (202)..(252): Pfam Name: PHD Pfam Description: PHD-finger
  misc_feature (1)..(257): Functional Homolog of  Ceres CLONE NO.156373 at SEQ ID NO.575 with e-value of 1.49E-83 and BLAST sequence identity of 67.3
MEGMAQHPVPRTVEEVFSDYKGRRAGLIKALTTDVEKFYQLVDPEKENLCLYGFPNETWEVNLPVEEVPPELPEPALGINFARDGMQEKDWLSLVAVHSDSWLLAVAFYFGARFGFGKNDRKRLFQMINDLPTVFELATGTAKQSKDQLTAHNNGSNSKYKSSGKSRQSESQTKGVKMSAPVKEEVDSGEEEEEDDDEQGATCGACGDNYGTDEFWICCDMCEKWFHGKCVKITPAKAEHIKQYKCPGCSIKKPRIG

SEQ ID NO: 597 - protein, 244 aa, Oryza sativa
  misc_feature: Public GI ID NO.34900462
  misc_feature (189)..(239): Pfam Name: PHD Pfam Description: PHD-finger
  misc_feature (1)..(244): Functional Homolog of  Ceres CLONE NO.156373 at SEQ ID NO.575 with e-value of 9.10e-93 and BLAST sequence identity of 71.7
MEMAAPVSPAPRTVEDIFKDFSGRRAGLVRALTVDVDEFYGFCDPEKENLCLYGHPNGRWEVALPAEEVPPELPEPALGINFARDGMHRRDWLSLVAVHSDSWLLSVAFFFGARLNGNERKRLFSLINDHPTVLEALSDRKHGRDNKSGADNGSKSRHSGKRANDVQTKTSRPAVVDDGYDEEEHSETLCGTCGGRYNANEFWIGCDICERWFHGKCVRITPAKAEHIKHYKCPDCSSSKKSRQ

SEQ ID NO: 598 - protein, 245 aa, Lycopersicon esculentum
  misc_feature: Public GI ID NO.45387429
  misc_feature (1)..(245): Functional Homolog of  Ceres CLONE NO.156373 at SEQ ID NO.575 with e-value of 1.40e-94 and BLAST identity of 72.2
MATNSSSHSPRTVEEIFKDFSARHAAVLRALTTDVEDFYSQCDPERDNLCLYGHPNESWEVAVPAEEVPPELPEPVLGINFARDGMERRDWLSLVAMHTDSWLLSVAFYFGARLNRNERSRVFTLINDLPTVFEAVTGRKPLKDKPSVDSGKKSKNNAKREKQMKANQRLQEESDDEDEGNEDEHEETLCGSCGTNGNEDEFWIGCDMCEKWYHGKCVKITPAKAQSIKEYRCPSCSNKRAKHMA

SEQ ID NO: 599 - protein, 248 aa, Solanum tuberosum
  misc_feature: Public GI ID NO.63028790
  misc_feature (194)..(244): Pfam Name: PHD Pfam Description: PHD-finger
  misc_feature (1)..(248): Functional Homolog of  Ceres CLONE NO.156373 at SEQ ID NO.575 with e-value of 3.60e-89 and BLAST identity of identity of 68.6
MENSVPRTVEEVFSDFKSRRAALIKALTTDVEKFYQQCDPEKENLCLYGLPNETWEVNLPVEEVPPELPEPALGINFARDGMQEKDWLSLVAVHSDSWLLSVAFYFGARFGFGKSERKRLFQMINDLPTVFEVVTGAAKQTRDPPHNNSNKSKSSGKPRQPESQLKAVKVSPPKMENDSGEEEEEEEDEQGATLCGACGDNYATDEFWICCDICERWFHGKCVKITPAKAEHIKQYKCPSCSSKRAKV

SEQ ID NO: 600 - protein, 252 aa, Arabidopsis pumila
  misc_feature: Public GI ID NO.75214624
  misc_feature (1)..(252): Functional Homolog of  Ceres CLONE NO.156373 at SEQ ID NO.575 with e-value of 3.70e-87 and BLAST identity of 64.5
MEGGAALYNPRTVEEVFKDFKGRRAAIVKALTTDVQEFYQQCDPEKENLCLYGLPNEEWEVNLPAEEVPPELPEPALGINFARDGLSEKEWLSLVAIHSDAWLLSVSFYFGSRFSFHKEDRKRLFNMINDVPTIFEVVTGMAKKQSKDKSSSANQNGNKSKSNSKVRTSDGKSSKAMQVKDEDEEVDEEDEDDHGETLCGACGDSDGADEFWICCDLCEKWFHGKCVKITPARAEHIKQYKCPSCSNKRARA

SEQ ID NO: 601 - protein, 241 aa, Arabidopsis thaliana
  misc_feature: Public GI ID NO.15239180
  misc_feature (187)..(237): Pfam Name: PHD Pfam Description: PHD-finger
  misc_feature (1)..(241): Functional Homolog of  Ceres CLONE NO.156373 at SEQ ID NO.575 with e-value of 9.00e-116 and BLAST sequence identity of 88.3
MAAESSNPRTVEEIFKDFSGRRSGFLRALSVDVDKFYSLCDPEMENLCLYGHPNGTWEVNLPAEEVPPELPEPALGINFARDGMQRKDWLSLVAVHSDCWLLSVSSYFGARLNRNERKRLFSLINDLPTLFEVVTGRKPIKDGKPSMDLGSKSRNGVKRSIEGQTKSTPKLMEESYEDEDDEHGDTLCGSCGGNYTNDEFWICCDVCERWYHGKCVKITPAKAESIKQYKCPSCCTKKGRQ

SEQ ID NO: 602 - DNA, 1148 bp, Glycine max
  misc_feature: Ceres Clone ID no.513477
  misc_feature: Encodes the peptide sequence given at SEQ ID NO 603
aacacacacaattatctcatcacaacaactactagctacgtactactactttgcctagcttctctttcttttttcttttctctctccccccttttgcgctaaacttcactctctcttctatatcaagggttgatcacagaacctcaatatatttctaataataattgataaagtttgagttattgtttcgagacaaagaaaaagagagagagagagagagatatgggtagagggagagttgagctgaagaggatagagaacaaaatcaaccgccaagtaactttctcaaaaagaaggaacggtttgctcaagaaagcctatgagctctcagttctctgtgatgctgaggttgctctcatcattttctcaagccgtggcaagctctatgaatttggaagtgttgggactaccaaaactattgagcgataccatcgtagctcttttactcctcaagacgaacacgttgaatgtgaaactcagagctggtaccaagaggtatcaaagctaaaggcaaagtatgattctcttcaaaggacccagaggcatttgcttggggaagatcttggaccattgaacataaaggagctgcagaatcttgagaaacagcttgaaggggctttagcacaagcaaggcaaaggaagacacaaatcatgattgaacaaatggaagagcttcgcagaagggagcgccatcttggagacatgaataagcaactgagactcaagcttgaagcagagggatttaatcttaaagctatggaaagcttgttgagctctacttcagaagctggaaatagtggctttcactttcagcagcctcctcaaaccaatcctatggattaccagcaggcagaaccctttttgcaaatagggtaccatcaatatgttcaagctgaggcttctaatgttccaaagagcatggcttgtgaaactaatttcatgcagggatggatcctttgatcaatcttattgaattaagtatatgatgatttaccttattgtctatatgctttttagatttgtgttttggatgttgttaaatgtaactttgtgaccagaaaagttgcagacttgtttagcactttctgtaattggacacaagtacagacaatggtttaactatatgttaaagtaatgctattgttttt

SEQ ID NO: 603 - protein, 245 aa, Glycine max
  misc_feature: Ceres Clone ID no.513477
  misc_feature (9)..(59): Pfam Name: SRF-TF Pfam Description: SRF-type transcription factor
  misc_feature (1)..(245): Functional Homolog of  Ceres CLONE NO.241491 at SEQ ID NO.96 with e-value of 9.80e-76 and BLAST sequence identity of 67.8
MGRGRVELKRIENKINRQVTFSKRRNGLLKKAYELSVLCDAEVALIIFSSRGKLYEFGSVGTTKTIERYHRSSFTPQDEHVECETQSWYQEVSKLKAKYDSLQRTQRHLLGEDLGPLNIKELQNLEKQLEGALAQARQRKTQIMIEQMEELRRRERHLGDMNKQLRLKLEAEGFNLKAMESLLSSTSEAGNSGFHFQQPPQTNPMDYQQAEPFLQIGYHQYVQAEASNVPKSMACETNFMQGWIL

SEQ ID NO: 604 - DNA, 1262 bp, Zea mays
  misc_feature: Ceres Clone ID no.380978
  misc_feature: Encodes the peptide sequence given at SEQ ID NO 605
cccgagccggctcattatatcgtccgtcgcgcagacaacgcaagtttgctagcggccggatcagcagccacagcgcgaagagagcaaccacgctgcacacagaggcgccgtgtgtgagatagagcaagctcgatcgaaggaaggagggaagctagagatcgtacgttcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttatt

SEQ ID NO: 605 - protein, 255 aa, Zea mays; identical to SEQ ID NO: 109
  misc_feature: Ceres Clone ID no.380978
  misc_feature (9)..(59): Pfam Name: SRF-TF Pfam Description: SRF-type transcription factor
  misc_feature (1)..(255): Functional Homolog of  Ceres CLONE NO.241491 at SEQ ID NO.96 with e-value of 3.30e-119 and BLAST sequence identity of 92.9

SEQ ID NO: 606 - DNA, 900 bp, Oryza sativa
  misc_feature: Public gi NO.50911963
  misc_feature: Encodes the peptide sequence given at SEQ ID NO 607
atggactccgactggctcaagggcatcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaataactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcatcatcttgcgccgccgccgccggcggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcgtcgcggagtaccatgcgctgagcgcgctccggttcgcggcagggctcggcgatcacctggcgctgccgttcggcgcggtgcgggcggagcacgacgccgtcgaggtgaagccggtggcggcggagaggctgctgtcgctcgagtggtgcggcgaggcgagccgcacggcggcgccggagagctccattagctcgctgggcgggctgggactgtggagcggcatgatcggcggcgggcaccatcaccatggctcctccgctgccatctga

SEQ ID NO: 607 - protein, 299 aa, Oryza sativa; identical to SEQ ID NO: 334
  misc_feature: Public gi NO.50911963
  misc_feature (1)..(299): Functional Homolog of  Ceres ANNOT ID NO.543998 at SEQ ID NO.327 with e-value of 1.00e-23 and BLAST sequence identity of 85.2

SEQ ID NO: 608 - DNA, 1683 bp, Triticum aestivum
  misc_feature: Ceres CLONE ID no.751992
  misc_feature: Encodes the peptide sequence given at SEQ ID NO 609
cccctctctccctctgtatcctgcacacaccgccaccgatcactcgccggagcccctccccccaatggccsccgcgcgccgccgcgatcgcgtgatggccgacccagccgctcgccgaagatggacgaagccggaagggcctccgctcccgcggtggtgacggtcacggcctccgccgccgccccctcgcctcctcctcccccgccccccgccaccggccaccgccgcggccgccgacccgccatcgcccgacccggacgctctctatgaagagggaatgtggcagcagatggccatgagcagcggcgccactatgcaatctgggccatatcctgtgcggccaggggaaccggactgcacctactacctcaggactggattgtgcaggttcggcatgagctgcaggttcaatcaccctcaggacaggaatacggctattgcctctgccagaatgaaaggagaatatcctgagagggtgggacaacctgaatgtcagtactatctgaagactggaacatgcaagtttgggcctacgtgcaaattccatcaccctagagaaaaggctggaatcgcaggaatggtgcagctaaacacattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacataactctggaagcaccggtccacattcctatactggaacaatggcaagctggacttatccaagaggttctttcattccaagccctagatggcaaagtccttcaaactatacaccgatgattgtaccacagggtcttgttcaagtaccaaactggaactcatatcctggccaaatggtacctgtttcatctcctgagagtcgactacagtctccaggggctcaacaatactatggaacttctcgacaaggtgaagccagygcaggaaatcagggaatgcaatcaycctacagatccagttcgtttcctgcacctcagtatgcactgcagagagagaatgtatttcctgagagacctgatcagccagaatgcatatactacataaagactggagattgtaaatttggtgcggtttkmaaattccatcatccccgggtgcgctcacagcctcccccagactgtatcttgagcccaatgggtcttccattacgcccaggcgaagagctctgcaagttctactctcgctatggcatctgcaagttcggcgtaaactgcaagttcgaccatccaatggcggctccgatgggggtctacgcgtacggctactctgcctcggcgtcgcccaacgcgcccatggggtcggcgtctcctggagtccccctccgggtctgcgtacgcctcctaaggcaaggctccctggcatttgaccctaccttgattgatctcgatgatgtataaaagccatcgcgagctgtcgtccctccctcgggcgcgccccgcgaatgttctcccccctaactccccggaatcaagttctgtaaaaatcgagtttgctaccagagatgtacagttgttatttttgttaatgcgggtcagtgtttggatggatggagaarccatttgctaccgaatgaaataatgcttgaatgcagtgtttg

SEQ ID NO: 609 - protein, 401 aa, Triticum aestivum
  misc_feature: Ceres CLONE ID no.751992
  misc_feature (1)..(401): Functional Homolog of  Ceres ANNOT ID NO.149496 at SEQ ID NO.436 with e-value of 1.40e-63 and BLAST sequence identity of 47.4
  misc_feature (243)..(243): Xaa can be any naturally occurring amino acid
  misc_feature (252)..(252): Xaa can be any naturally occurring amino acid
  misc_feature (295)..(295): Xaa can be any naturally occurring amino acid
MWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPNWNSYPGQMVPVSSPESRLQSPGAQQYYGTSRQGEAXAGNQGMQSXYRSSSFPAPQYALQRENVFPERPDQPECIYYIKTGDCKFGAVXKFHHPRVRSQPPPDCILSPMGLPLRPGEELCKFYSRYGICKFGVNCKFDHPMAAPMGVYAYGYSASASPNAPMGSASPGVPLRVCVRLLRQGSLAFDPTLIDLDDV

What is claimed is:

1. A method for inducing early flowering in a plant, said method comprising:
    introducing into a plant cell an isolated nucleic acid molecule comprising a nucleotide sequence selected from the group consisting of:
    (a) a nucleotide sequence that encodes an amino acid sequence that is a Dof protein and is at least 85% identical to SEQ ID NO: 327; and
    (b) a nucleotide sequence that is fully complementary to the nucleotide sequence according to paragraph (a),
    generating from said plant cell a transformed plant in which said nucleic acid molecule is overexpressed; and
    selecting from a plurality of said transformed plants a plant having early flowering as compared to a control plant that does not comprise said nucleic acid molecule.

2. The method according to claim 1, wherein said isolated nucleic acid is operably linked to a regulatory region.

3. The method according to claim 2, wherein said regulatory region is a promoter selected from the group consisting of: YP0092 (SEQ ID NO: 38), PT0676 (SEQ ID NO: 12), PT0708 (SEQ ID NO: 17), PT0613 (SEQ ID NO: 5), PT0672 (SEQ ID NO: 11), PT0678 (SEQ ID NO: 13), PT0688 (SEQ ID NO: 15), PT0837 (SEQ ID NO: 24), a napin promoter, a Arcelin-5 promoter, a phaseolin gene promoter, a soybean trypsin inhibitor promoter, an ACP promoter, a stearoyl-ACP desaturase gene, a soybean α' subunit of β-conglycinin promoter, a oleosin promoter, a 15 kD zein promoter, a 16 kD zein promoter, a 19 kD zein promoter, a 22 kD zein promoter, a 27 kD zein promoter, a Osgt-1 promoter, a beta-amylase gene promoter, a barley hordein gene promoter, p326 (SEQ ID NO: 76), YP0144 (SEQ ID NO: 55), YP0190 (SEQ ID NO: 59), p13879 (SEQ ID NO: 75), YP0050 (SEQ ID NO: 35), p32449 (SEQ ID NO: 77), 21876 (SEQ ID NO: 1), YP0158 (SEQ ID NO: 57), YP0214 (SEQ ID NO: 61), YP0380 (SEQ ID NO: 70), PT0848 (SEQ ID NO: 26), and PT633 (SEQ ID NO:7), a cauliflower mosaic virus (CaMV) 35S promoter, a mannopine synthase (MAS) promoter, a 1' or 2' promoter derived from T-DNA of *Agrobacterium tuniefaciens*, a figwort mosaic virus 34S promoter, an actin promoter, a ubiquitin promoter, a ribulose-1,5-bisphosphate carboxylase (RbcS) promoter, a pine cab6 promoter , a Cab-1 gene promoter, a pyruvate orthophosphate dikinase (PPDK) promoter, a tobacco Lhcb1*2 promoter, an *Arabidopsis thaliana* SUC2 sucrose-H+ symporter promoter, and thylakoid membrane protein promoters from spinach (psaD, psaF, psaE, PC, FNR, atpC, atpD, cab, rbcS, PT0535 (SEQ ID NO: 3), PT0668 (SEQ ID NO: 2), PT0886 (SEQ ID NO: 29), YP0144 (SEQ ID NO: 55), YP0380 (SEQ ID NO: 70) and PT0585 (SEQ ID NO: 4).

4. A vector, comprising:
    (a) a nucleic acid molecule having a regulatory region encoding a plant transcription and/or translation signal; and
    (b) an isolated nucleic acid molecule comprising a nucleotide sequence selected from the group consisting of:
        (i) a nucleotide sequence that encodes an amino acid sequence that is a Dof protein and is at least 85% identical to SEQ ID NO: 327; and (ii) a nucleotide sequence that is fully complementary to the nucleotide sequence according to paragraph (i), wherein the nucleic acid molecules from (a) and (b) are operably linked, and wherein a plant produced from a plant cell transformed with said vector exhibits early flowering as compared to a control plant.

5. A plant cell, comprising:
an isolated nucleic acid molecule comprising a nucleotide sequence selected from the group consisting of:
  (a) a nucleotide sequence that encodes an amino acid sequence that is a Dof protein and is at least 85% identical to SEQ ID NO: 327; and
  (b) a nucleotide sequence that is fully complementary to the nucleotide sequence according to paragraph (a),
  wherein a plant produced from said plant cell flowers early compared to a control plant that does not comprise said nucleic acid molecule.

6. A transgenic plant comprising the plant cell according to claim 5.

7. Progeny of the plant according to claim 6, wherein said progeny contain the isolated nucleic acid molecule and flower early as compared to a control plant.

8. Seed produced by the plant according to claim 6, wherein said seed contain the isolated nucleic acid molecule.

9. Vegetative tissue of the transgenic plant according to claim 6.

10. A food product, comprising the vegetative tissue of claim 9.

11. A feed product comprising the vegetative tissue according to claim 9.

12. A method for inducing early flowering in a plant, comprising:
  (a) transforming a plant with the vector of claim 5; and
  (b) expressing said isolated nucleic acid molecule in said plant,
wherein said expression imparts an early flowering trait to the plant as compared to a non-transformed plant of the same species grown under identical conditions.

13. A method of inducing early flowering in a plant, comprising:
  expressing a nucleic acid molecule at a level above that normally found in a wild-type plant of the same species, wherein said nucleic acid molecule is selected from the group consisting of:
  (a) an isolated nucleic acid molecule that encodes an amino acid sequence that is a Dof protein and is at least 85% identical to SEQ ID NO: 327;
  (b) an isolated nucleic acid molecule that is fully complementary to the nucleic acid molecule according to paragraph (a);
  (c) an isolated nucleic acid molecule that is SEQ ID NO: 326; and
  (d) an isolated nucleic acid molecule encoding SEQ ID NO:327, wherein a plant produced from a plant cell transformed with said nucleic acid molecule exhibits early flowering as compared to a control plant.

14. The method according to claim 1, wherein the isolated nucleic acid molecule is SEQ ID NO:326.

15. The method according to claim 1, wherein the isolated nucleic acid molecule encodes SEQ ID NO:327.

16. The method according to claim 14, wherein the isolated nucleic acid molecule is operably linked to a regulatory region.

17. The method according to claim 15, wherein the isolated nucleic acid molecule is operably linked to a regulatory region.

18. The vector according to claim 4, wherein the isolated nucleic acid molecule is SEQ ID NO:326.

19. The vector according to claim 4, wherein the isolated nucleic acid molecule encodes SEQ ID NO:327.

20. The plant cell according to claim 5, wherein the isolated nucleic acid molecule is SEQ ID NO:326.

21. The plant cell according to claim 5, wherein the isolated nucleic acid molecule encodes SEQ ID NO:327.

22. A transgenic plant comprising the plant cell according to claim 20.

23. A transgenic plant comprising the plant cell according to claim 21.

24. Progeny of the plant according to claim 22, wherein said progeny contains the isolated nucleic acid molecule and flowers early as compared to a control plant.

25. Progeny of the plant according to claim 23, wherein said progeny contains the isolated nucleic acid molecule and flowers early as compared to a control plant.

26. Seed produced by the plant according to claim 22, wherein said seed contains the isolated nucleic acid molecule.

27. Seed produced by the plant according to claim 23, wherein said seed contains the isolated nucleic acid molecule.

28. Vegetative tissue of the transgenic plant according to claim 22.

29. Vegetative tissue of the transgenic plant according to claim 23.

30. A food product comprising the vegetative tissue of claim 28.

31. A food product comprising the vegetative tissue of claim 29.

32. A feed product comprising the vegetative tissue of claim 28.

33. A feed product comprising the vegetative tissue of claim 29.

34. The method according to claim 12, wherein the isolated nucleic acid molecule is SEQ ID NO:326.

35. The method according to claim 12, wherein the isolated nucleic acid molecule encodes SEQ ID NO:327.

* * * * *